United States Patent 9,216,205 (MODIFIED POLYNUCLEOTIDES ENCODING GRANULYSIN) - sequence listing, part 3

SEQ ID NO: 1617 - DNA, 3136 bp, Homo sapiens
ctgtctgagcatttcactgcggagcctgagcgcgcctgcctgggaaaacactgcagcggtgctcggactcctcctgtccagcaggaggcgcggcccggcagctcccgcatgcgcagtgcgctcggtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattccttttt

SEQ ID NO: 1618 - DNA, 3068 bp, Homo sapiens
ggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggcacgaagca

SEQ ID NO: 1619 - DNA, 3096 bp, Homo sapiens
ggacccgccccgccggggcttttgggagcgcgggcagcgagcgcactcggcggacgcaagggcggcggggagcacacggagcactgcaggcgccgggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtggtaaagactatcggcctccgggaagtgtggtactttggcctccactatgtggataataaaggatttcctacctggctgaagctggataagaaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaagggcagaggggtgctcatagcgggcgctgccagccccgccacgcttgtgtctttagtgctccaagtctaggaactccctcagatcccagttcctttagaaagcagttacccaacagaaacattctgggctgggaaccagggaggcgccctggtttgttttccccagttgtaatagtgccaagcaggcctgattctcgcgattattctcgaatcacctcctgtgttgtgctgggagcaggactgattgaattacggaaaatgcctgtaaagtctgagtaagaaacttcatgctggcctgtgtgatacaagagtcagcatcattaaaggaaacgtggcaggacttccatctgtgccatacttgttctgtattcgaaatgagctcaaattgattttttaatttctatgaaggatccatctttgtatatttacatgcttagaggggtgaaaattattttggaaattgagtctgaagcactctcgcacacacagtgattccctcctcccgtcactccacgcagctggcagagagcacagtgatcaccagcgtgagtggtggaggaggacacttggatttttttttttgttttttttttttttgcttaacagttttagaatacattgtacttatacaccttattaatgatcagctatatactatttatatacaagtgataatacagatttgtaacattagttttaaaaagggaaagttttgttctgtatattttgttaccttttacagaataaaagaattacatatgaaaaaccctctaaaccatggcacttgatgtgatgtggcaggagggcagtggtggagctggacctgcctgctgcagtcacgtgtaaacaggattattattagtgttttatgcatgtaatggactatgcacacttttaattttgtcagattcacacatgccactatgagctttcagactccagctgtgaagagactctgtttgcttgtgtttgtttgtttgcagtctctctctgccatggccttggcaggctgctggaaggcagcttgtggaggccgttggttccgcccactcattccttctcgtgcactgctttctccttcacagctaagatgccatgtgcaggtggattccatgccgcagacatgaaataaaagctttgcaaaggca

SEQ ID NO: 1620 - DNA, 1823 bp, Homo sapiens
gtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccaatcaatgtccgagttaccaccatggatgcagagctggagtttgcaatccagccaaatacaactggaaaacagctttttgatcaggtgtctgcccaggaggtcaggaaggagaatcccctccagttcaagttccgggccaagttctaccctgaagatgtggctgaggagctcatccaggacatcacccagaaacttttcttcctccaagtgaaggaaggaatccttagcgatgagatctactgcccccctgagactgccgtgctcttggggtcctacgctgtgcaggccaagtttggggactacaacaaagaagtgcacaagtctgggtacctcagctctgagcggctgatccctcaaagagtgatggaccagcacaaacttaccagggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgataagttaaccccaaagattggctttccttggagtgaaatcaggaacatctctttcaatgacaaaaagtttgtcattaaacccatcgacaagaaggcacctgactttgtgttttatgccccacgtctgagaatcaacaagcggatcctgcagctctgcatgggcaaccatgagttgtatatgcgccgcaggaagcctgacaccatcgaggtgcagcagatgaaggcccaggcccgggaggagaagcatcagaagcagctggagcggcaacagctggaaacagagaagaaaaggagagaaaccgtggagagagagaaagagcagatgatgcgcgagaaggaggagttgatgctgcggctgcaggactatgaggagaagacaaagaaggcagagagagagctctcggagcagattcagagggccctgcagctggaggaggagaggaagcgggcacaggaggaggccgagcgcctagaggctgaccgtatggctgcactgcgggctaaggaggagctggagagacaggcggtggatcagataaagagccaggagcagctggctgcggagcttgcagaatacactgccaagattgccctcctggaagaggcgcggaggcgcaaggaggatgaagttgaagagtggcagcacagggccaaagaagcccaggatgacctggtgaagaccaaggaggagctgcacctggtgatgacagcacccccgcccccaccaccccccgtgtacgagccggtgagctaccatgtccaggagagcttgcaggatgagggcgcagagcccacgggctacagcgcggagctgtctagtgagggcatccgggatgaccgcaatgaggagaagcgcatcactgaggcagagaagaacgagcgtgtgcagcggcagctgctgacgctgagcagcgagctgtcccaggcccgagatgagaataagaggacccacaatgacatcatccacaacgagaacatgaggcaaggccgggacaagtacaagacgctgcggcagatccggcagggcaacaccaagcagcgcatcgacgagttcgaggccctgtaacagccaggccaggaccaa

SEQ ID NO: 1621 - DNA, 2096 bp, Homo sapiens
gccgagagggcgggccagggccgcactccggagactcgcggttgctacgcgcaccatggctggagacggagtttcgctcttgatgcccagcaggctggagtgcaatggcgcgatttcagctcactgcaacctcctcctcccagaggtacttctcagccctctagctccaactgagaacccagccagtcaggaagtcgctacttcgggaacaccaaccaatcagggggccgtcacctgctgaaggagtccttcggcggctgttgtgtcgggagcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactaaaaatacaaagttagccaggcatagtggtgcatgcctgtaatcccagctgctcaggagcctggcaacaagagcaaaactccagctcaaaaaaaaaaagaaagaaaagaaa

SEQ ID NO: 1622 - DNA, 2170 bp, Homo sapiens
cactccggagactcgcggttgctacgcgcaccatggctggagaggtacttctcagccctctagctccaactgagaacccagccagtcaggaagtcgctacttcgggaacaccaaccaatcagggcggctggctctcagtcccctcgctgtagtcgcggagctgtgtctgttcccaggagtccttcggcggctgttgtgtcgggagcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactaaaaatacaaagttagccaggcatagtggtgcatgcctgtaatcccagctgctcaggagcctggcaacaagagcaaaactccagctcaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtc

SEQ ID NO: 1623 - DNA, 4665 bp, Homo sapiens
ggggttccacctggcggctggctctcagtcccctcgctgtagtcgcggagctgtgtctgttcccaggagtccttcggcggctgttgtgtcgggagcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactaaaaatacaaagttagccaggcatagtggtgcatgcctgtaatcccagctgctcaggagcctggcaacaagagcaaaactccagctcaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttgttgttttttgttttgttttgttttgtttttttaaagacggagtctcgctctgtcacccaggctggagtgcagtggtatgatcttggctcactgtaacctccgcctcccgggttcaagccattctcctgcctcagtctcctgagtagctgggattacgggtgcgtgccaccatgcctggctaatttttgtgtttttagtagagacagggtttcaccatgttggtcgggctggtctcaaactcctgacctcttgatccgcctgccttggcctcccaaagtgatgggattacagatgtgagccaccgtgcctagccaaggatgagatttttaaagtatgtttcagttctgtgtcatggttggaagacagagtaggaaggatatggaaaaggtcatggggaagcagaggtgattcatggctctgtgaatttgaggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgagtttgtttaaatcctgaagttcttaccttaagagaattgggactcctagagtgattggacattcaaaatattcctgatagtcttgttaattaagagattaggatatctttccattaccttgataattacgttttaatttagcttttttcattggcctgtgtttaaatgcaaataaccccacaatggacatttcctatgttaaagtgacatttaggggataaaaaatgagagcagttccatggattttggtgtttcccctgagacatgaactcagcataatctgggataaaatgattgagtgttaaggatgtgtttgttgttcctgtcgtttttttattttcttcaaagtatacaacatggtttgatatgcacatacatttgtgtaatgattgccatggtcaattaacacatcaccatttttgtgtgtgtgtgtgtgtgtgtgtgtgagggagtcttgctccgttgccaggctggagtgcaatggtacaaccttggctcactgcaacctccacctcctgggttcaagcaattctcttgcctcagcctcctaagtagctgggactataggcgtgtgccaccatgcccagctaatttttgtatttttagtagagacggggtttcaccatgttggccaggatgatctcgatcccttgacctcatgatccgcccacctcggcctcccaaagtgctgggattacaggcgtgagtcactgcacccggccacatcacctcccatgttctatcttacgtattcagaacttgttcatcttgtaactgaaagcgtgtaccctttgaccaacactgtttttcctgtcttaacaggatctacagatcaaggacaggggaggggatagtggaggaaaacggagttagtctgtttctaaatgaggggacagtatgtttcttggggcctgaggacagcttaataaagtagacaaatgaagaaaaacaacaatttgcattaaaaaatatccaattcttta

SEQ ID NO: 1624 - DNA, 1162 bp, Homo sapiens
gcttccggatccggtctcagctctgggagggaacgggagatgttgcaggcgccgagagggcgggccagggccgcactccggagactcgcggttgctacgcgcaccatggctggaggctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagcttcctatgaggaccgggtgaccttcttgccaactggtatcaccttcaagtccgtgacacgggaagacactgggacatacacttgtatggtctctgaggaaggcggcaacagctatggggaggtcaaggtcaagctcatcgtgcttgtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggc

SEQ ID NO: 1625 - DNA, 1245 bp, Homo sapiens
gttgtgtcgggagcctgatcgcgatggggacaaaggcgcaagtcgagaggaaactgttgtgcctcttcatattggcgatcctgttgtgctccctggcattgggcagtgttacagtgcactcttctgaacctgaagtcagaattcctgagaataatcctgtgaagttgtcctgtgcctactcgggcttttcttctccccgtgtggagtggaagtttgaccaaggagacaccaccagactcgtttgctataataacaagatcacagtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtctttgatcccctgtcagcctctgatactggagaatacagctgtgaggcacggaatgggtatgggacacccatgacttcaaatgctgtgcgcatggaagctgtggagcggaatgtgggggtcatcgtggcagccgtccttgtaaccctgattctcctgggaatcttggtttttggcatctggtttgcctatagccgaggccactttgacagaacaaagaaagggacttcgagtaagaaggtgatttacagccagcctagtgcccgaagtgaaggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggtt

SEQ ID NO: 1626 - DNA, 4949 bp, Homo sapiens
ccgcgcccgcgcccccgccgccgccatgggcgtgcagggcttccaggactacatcgagaagcactgcccgagcgccgtggtgccggtggagctgcagaagctggcccggggcagcctggtgggcggcgggcggcagcggcccccgcagaccccgctgcgcctgctggtggacgccgacaactgcctgcaccgcctctacggcggcttctacaccgactgggtcagcggcggccagtggaaccacatgcttggctacctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcactggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctttagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttagt

SEQ ID NO: 1627 - DNA, 5041 bp, Homo sapiens
ccgcgcccgcgcccccgccgccgccatgggcgtgcagggcttccaggactacatcgagaagcactgcccgagcgccgtggtgccggtggagctgcagaagctggcccggggcagcctggtgggcggcgggcggcagcggcccccgcagaccccgctgcgcctgctggtggacgccgacaactgcctgcaccgcctctacggcggcttctacaccgactgggtcagcggcggccagtggaaccacatgcttggctacctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcactggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaagcctttccaactctacttgcaaaaaaactttgtgtttcacaaagagaattccatcgtgctctgctccaggatcctgaggcatggccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctttagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttagtataaagta

SEQ ID NO: 1628 - DNA, 4819 bp, Homo sapiens
ccgcgcccgcgcccccgccgccgccatgggcgtgcagggcttccaggactacatcgagaagcactgcccgagcgccgtggtgccggtggagctgcagaagctggcccggggcagcctggtgggcggcgggcggcagcggcccccgcagaccccgctgcgcctgctggtggacgccgacaactgcctgcaccgcctctacggcggcttctacaccgactgggtcagcggcggccagtggaaccacatgcttggctacctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcactggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctttagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttagtataaagta

SEQ ID NO: 1629 - DNA, 3585 bp, Homo sapiens
ccgcgcccgcgcccccgccgccgccatgggcgtgcagggcttccaggactacatcgagaagcactgcccgagcgccgtggtgccggtggagctgcagaagctggcccggggcagcctggtgggcggcgggcggcagcggcccccgcagaccccgctgcgcctgctggtggacgccgacaactgcctgcaccgcctctacggcggcttctacaccgactgggtcagcggcggccagtggaaccacatgcttggctacctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcactggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaaggtattatcaaaggggccctggagtggcttctgttatttgatgagtggccattcctatgggtgttttgtccttttgtccttttttgaaccatttttctgtcttactaatctacttgaaacaaagttcactttcccctttctaaacattgaatgaaagatgaacatttataactgtaaatagttttaaaataactcgtgaaaagtctcacttttttccttcaacttagtatagaatattttatacttctaatgaaataatgcatcacattattttatgacttgtaattttattctttttacttcaatttcagaattttcttaaaccatatttgtgctgtaatgtcaggtttaattctgatgtcagatacaatatctggttcctttatcatttgtgcttagaaaataatgtttccccctttgaatggctcatagtgcttcatgtgttttgacttgttcatgacctcattgagtgcagttttaatagtgctaagaacaaaaaatataatacaggattttgttaacatacgcatagtcagaaaatgaaactatcattttatacagtgtcataatttcactttattagtgtcttaatgtatgcttaaatatatacatatagtgtggcatcaattattttttaatcttggtgtctcaaatgtatctatgtgtatttaaatttcctcagtgatttgtagtctttatgttggcacttttaatcttagccccacaatttaacaagttacctcagttactagattaatcctgcagaactggtttattgctatcatgtattattaacatgaatacctatatgaccatatataaccagacttttctgtctattctctacaacccatctgtggtttgtaaaatggagtcaataaatgcaataatgaactcctgttctcaaatactcctgaggtggacttcaactgttaactgactaatccaaatattgcttacttttattaattaaaggacatggaaaacatgtagccagtactatttgctcagatcctttaatttattttttagttgtaatgcctccaaatctcatctattatttgatatgggtatgcatttatagtatcacttttcagattatggttgtaaggtgaacattttatttttcaggttcaacataaattataaagggtaagtgaaaagtaattgttgtggggaaaacattttgctaagtttaaggaaccaaagttttgggaagacatctttcaaaataaggtgtgaagaaacaacactcattcctcgtggggctgtttgaaatgtaaggtccccaggagctacctgttatgtccacactgctggatctgatgcgtggatagtcggttagatctatatgagggttgcaaattgtaccgacatgctttcttatttcttatgaatttcaagggcaaatactgataaaatgaccatggttgagaaaattgtcttttcacattttaaaatgctacttaagttttttcagtttatcctataagctgaatggctctggtattaattgcccaggctaagacatttacagtgagatgcatctttatggtaatgaagagaatttgcaaagcatcatattattgagataaatattccctagatgagagtgttagaacacatgtagctactggattaatgaatatgaaagtatggagggtaaggggaaagaccagtttttaaattaaacttatgtgaatgaaagaaacagcaaatattacaaaattattatttaaagcatatatatcaatgaacttcatagacattgaggtcataaatgcattgttgtgctctgagtataattaaataaaatttgttgcatga

SEQ ID NO: 1630 - DNA, 1710 bp, Homo sapiens
ggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaa

SEQ ID NO: 1631 - DNA, 1697 bp, Homo sapiens
aggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcactggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaatgtatgtactgtaacaatccattgtttgttttcctcggtacctcgtaatctcttgtgcattttctaaagccttagaagaatcatgactgagttgaccccgagtgcctctgtgtaaaggaggtgggcccatcatcggggcagtaggccagggtaaaggctcttagaaaaggaggagaagccacagactttcttcctcagtaacattccaataatgatgtttattcagtaaaataataaaacaggtttacactttaaagtgaa

SEQ ID NO: 1632 - DNA, 1430 bp, Homo sapiens
tcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacgctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtggtaagaaacacgctgctgaggcacaaatgcggagggccgctcttttcagaggcatcttgcaaatggttaagaacgagccctccttgaggttccttgctaagtaagtttataagctccattttagttgggacagattaagcacaaacttgtttaaagcaataagataatttactggctcactggtcaaccccaggaccaatgggcctatcatggggactgcctctctctgcaccacacccaccctcctgcaaga

SEQ ID NO: 1633 - DNA, 5460 bp, Homo sapiens
cgggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccggcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacatggctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgagggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttcctt

SEQ ID NO: 1634 - DNA, 1656 bp, Homo sapiens
cgggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctgagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtgattcaggctctagagctggccctgcctctcagccccccacatttctagaacacactgtagctgtgcctctacagactcccgctgcctggcctccacagatcctgctcagattcaccagtaggcaaagcttggccctattagctttttctctccatggctctgtggagatgtgcggagacccttacaggtcgggaggcggaagctgaggagtgggggctgggtggaaggtggacatcggggtttggtggaaatggggctctggggtttgcttccctctagtgtgggcaggggaccttgaagtgaagtcttgagaaaccagtagaatttgccactgtttccaggccttgtcaaccttttcattctttattttgctcctcatttcccatccctcacagtaactgtttaactgctcaattaaatgtgttgtaccgttcggtacttttactgaaacagtgaataaagcactgtgtgatttc

SEQ ID NO: 1635 - DNA, 1088 bp, Homo sapiens
ggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgagagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctct

SEQ ID NO: 1636 - DNA, 1000 bp, Homo sapiens
cgggcgcagggagccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctgagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctct

SEQ ID NO: 1637 - DNA, 2631 bp, Homo sapiens
aggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatatttat

SEQ ID NO: 1638 - DNA, 868 bp, Homo sapiens
cctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaa

SEQ ID NO: 1639 - DNA, 1971 bp, Homo sapiens
gcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttca

SEQ ID NO: 1640 - DNA, 983 bp, Homo sapiens
atgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctag

SEQ ID NO: 1641 - DNA, 2563 bp, Homo sapiens
gcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 1642 - DNA, 1044 bp, Homo sapiens
ggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaagtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctag

SEQ ID NO: 1643 - DNA, 1006 bp, Homo sapiens
atgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctag

SEQ ID NO: 1644 - DNA, 4641 bp, Homo sapiens
gcctagggaagggacactgattgttcaccatcatatcccagtatctagcacagtgcctaagggataggaggggctcagtaaatatctcttgcaaggatgttgttaaattgtaaactctgccaaggcctttatgttgaatgaatgaatgaacgaatgaatgaatgcctctaactcttcataaaataaacactttttggaaaaaattgctcatggcagacgtcagatgtaaccacactgataactggaaagaaaaatgaatttagatgggttttagagatagaacaatgtttctaatattcaagcagtccataaatcccttatacttaatgttaaaattcaggatatgatacctaaagaaaggttttactgtacttggatcaaggcacctaccaactttttctctactcataggcaaagtcactaccctgtttaaggaggtctttggacgtttccatctcaagaaacagctcttcaatctctcccttgtattccaccttccagaaccacccagaaattccagtaaagtcttattgacctgattgtctgtcctcttcgctgagttccttttgaatgcagcaaattgctgtgcccttttctgacttccatttcacttttatccagcttcataggagcttaggcccctgcttgttgaggagggcgttcagttagtgctgagactacctgaataggtctggttctagctactcacaactcagagaggtagtgaatgctaggaggtaggaagaaggacattcaaccagaatactaaaattgcatttagatagtccagaaattagacagttggcacagcattagaattccccatttatccttacaatagtttgctgagaatgatggttgggaattgaacaatgagaacacttggacacaggaagaggaacatcacacaccggggcctgttgtggggtggggagagcggggagggatagcattaggagatatacctaatgtaaatgacaagttaatgggtacagcacaccaacatggcacgtgtatacatatgtaacaaacctgcacgttgtgcacatgtaccctagaacttaaagtataataaaaaagtgtgtgtgtgtgtgtgtgtgtgtatatatataaagaattccccacttaatatttatacatccaaaaactgacaaaaataatgtctgaactcatgtctgacattcagattcctccgcccaaaggcaataaataaaataatactaagatgtaaaggcaaaccttgtcttctgtcatgatctacagatggcacaaataatagacattttcccgaataatggcgtctgattttcaagcaatgcttagccaattgtagatttgggcagaaaaagtttgtaccaagcatttgagctggaaaaggcagatatttttcttgacctcacttttcctaaagttcacaacttctgctacttaaatgagtatctcatctctaagtgtgtgaagtaacagatgatgtatctgtttttcatcctcaaagagttaacttgataaaataagtacagctaaggacaaacacaaacacaaaatgagaaaacttcatgcagtatgttttgtgttttgtaaagggtgccaatggcatggagccatctgattctgttgcagtctttggcaacacggcccatttaaattcaagttaggatctgagtgtttgggtaaacagaataagctaagaatgagtggcagacatatttcctcaaatcccatctgatacaggtttagatccagattttgtcatttgactaactccttccttttttagatgatttggatttgcctttttttcttataataaaagtcataatgccaaccactttaagagttcttttgctgctcttttttgttgctatctttttgtaactaataggacacgtgtaagactataatacaaacaggagtcctagcatgtaatggctttagcaatttgtgcaatatccctctttttgtccttcctgcatattttctccctagaaagcagccaagaattggtgttcagagggtgatgctctgatggtgagcagatctacagtttgcctaacagtttatttaagccaaatttatagtttctgaagcgctagaaggctgctgtccaaggggactacttttttttttttttttagatggagtcttgctctgtcgccaggctggagtgcagaggcgtgatctcagctcactgcaacttctgcctccccagttcatgctattctcctgcttcagtctcctaaggagctgggactacaggctcacaccaccacgcccagttaatttttgtatttttagtagagacagggtttcaccatgttggccaggatggtctcaatctcttgaccttgtgatccacccgcctcagcctcccaaagtgctgagattacaggcatgagccaccacgcccagccagggactacttattaactggccatttaaaatgaaatgaaacaaggtcctcaattgctaacgattaaggggagaggagtgtaaattcagctattgtcttgtcttcaggcagcaggaaattaagggattggtaactgttatttgtaatagtaattgatgtcacaaaaggagttttgagaacagggagtttaggaaaaaaattgatctccttttatttttagtctgttaatatttaatgtaatatttgatacagttcgatttagatttactgttctttgatctatttttattttttgccttttttgttgttctctttcttctctcctgccttcttttatattgtttaattttttttctaaatttcattgtaatttatctattagctttttaactatatcttttggcattatttttacaaagttgctctagggattacaatatacatccttaaatactcaccatctacttcatggaaattactgtaaccttacaaatgtataaatcgattttacccttgttcatcccattataatgtatattataagcctcatacaatggtatgatttttactttttctctgcgttgtttctagttaactatatgtgctatcaaagtgagaccccatttatcttttaatctgtttctgattgtttttccagtgtctacttaactgagactcttacaggtaattttgtaggatactaggtgttttagatggcaaatataaagattgtgtttgtgtatgtgtatgtgtttatatgtgagggccaatctattgaaaagaaacactgcagaatactaaagcaaaattgaaaccatttagagtttgtagttgttttattttaaaagctaaccttgtaagtacttagtctttcaaaaaataattttaacttctatgttttatttttctattttaatttttcctgggccttgcctcccaatcctctcaccttccctttcttctgtgtgacctatagattcagaaattcctttctgggataatttctggcactgctttggagatggagcccctgaaaattggctatggaccaaatggattcccactcttggggatctctaggtcatcatcaccatctgaacagctctgagagagacaagaagtggaatggagaaggtgattagatgctcagagtgtgtgcacaaggctggcacgcccagggtcttcctcatggcactaacagtctactgaaaggtggaacagagacaagcctatcaacacctacaagactggtggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgtaggtattgaaatagatttttcagatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctag

SEQ ID NO: 1645 - DNA, 1841 bp, Homo sapiens
gacgatacgccgggcgcaggcgcagaagccgcgcccgtccgcggcgccgccagccagggcggaaacggctgcggcttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcacggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatactacaaaaaa

SEQ ID NO: 1646 - DNA, 1846 bp, Homo sapiens
agagagagagagatagagaaagagaaagacagaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagaggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaat

SEQ ID NO: 1647 - DNA, 1888 bp, Homo sapiens
agagagagatagagaaagagaaagacagaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagagtctaccagccagatgcacacagcatcatctttggagaagcaaataggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaat

SEQ ID NO: 1648 - DNA, 14758 bp, Homo sapiens
ctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccagaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttccagcacacctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggtacttttggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaat

SEQ ID NO: 1649 - DNA, 14786 bp, Homo sapiens
agcgtgaggcgccggcgccgagctgggcggccgggcgcggggagagggcgcgggagcggctcgtgcggcaggtaccatgcggacgcgcgagcccggcgagggccccggcaggcccggtccctgctcgggggcgcgctgagacggcgggtgagctccacgagagcgccgtcgccacttcgggccaactttgcgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacccgtgttttccagctttgtggaaaaggggacagtgaaagaagatgcacctgttggttcattggtaatgacggtgtcggctcatgatgaggacgccagaagagatggggagatccgatactccattagagatggctctggcgttggtgttttcaaaataggtgaagagacaggtgtcatagagacgtcagatcgactggaccgtgaatcgacctcccattattggctaacagtctttgcaaccgatcagggtgtcgtgcctctttcatcgttcatagagatctacatagaggttgaggatgtcaatgacaatgcaccacagacatcagagcctgtttattacccagaaatcatggaaaattctcctaaagatgtatctgtggtccagatcgaggcatttgatccagattcgagctctaatgacaagctcatgtacaaaattacaagtggaaatccacaaggattcttttcaatacatcctaaaacaggtctcatcacaactacgtcaaggaagctagaccgagaacagcaagatgaacacatattagaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcaattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtattcatcaaagtaatagacacaaatgaccatcgtcctcagttttctacatcaaagtatgaagttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaagactttatattcagacactattcctgaagacgtccttcctggaaaattgatcatgcagatctctgctacagacgcagacatccgctctaacgctgaaattacttacacgttattgggttcaggtgcagaaaaattcaaactaaatccagacacaggtgaactgaaaacgtcaaccccccttgatcgtgaggagcaagctgtttatcatcttctcgtcagggccacagatggaggaggaagattctgccaagccagtattgtgctcacgctagaagatgtgaacgataacgcccccgaattctctgccgatccttatgccatcaccgtgtttgaaaacacagagccgggaacgctgctgacaagagtgcaggccacagatgccgacgcaggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggttatggccgatgatgccgatggaccttccaacagccacatccactactcaattatagatggcaaccaaggaagctcgttcacaattgaccccgtcaggggagaagtcaaagtgaccaaacttctcgaccgagaaacgatttcaggttacacgctcacggttcaagcttctgataatggcagtccacccagagtcaacacgacgaccgtgaacatcgatgtgtccgatgtcaatgacaacgcgcccgtcttctccaggggaaactacagtgtcattatccaggaaaataagccagtgggcttcagcgtgctgcagctggtagtaacagatgaggattcttcccataacggtccacccttcttctttactattgtaactggaaatgatgagaaggcttttgaagttaacccgcaaggagtcctcctgacatcatctgccatcaagaggaaggagaaagatcattacttactgcaggtgaaggtggcagataatggaaagcctcagttgtcatctttgacatacattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtgtcagcttagtccatactgcaaagatgaaccctgtaagaatggcggaacatgctttgacagtttggatggcgccgtttgtcagtgtgattcgggttttaggggagaaaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacacaaaagtggtggatcttgatccctgtctttccaagaagcctctagaggaaaagccttcccagccatacagtgcccgggaaagcctgtctgaagtgcagtctctgagctccttccagtccgaatcgtgcgatgacaatgggtatcactgggatacatcagattggatgccaagcgttcctctgccggacatacaagagttccccaactatgaggtgattgatgagcagacacccctgtactcagcagatccaaacgccatcgatacggactattaccctggaggctacgacatcgaaagtgattttcctccacccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttgagcttta

SEQ ID NO: 1650 - DNA, 1852 bp, Homo sapiens
aagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactgattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtag

SEQ ID NO: 1651 - DNA, 941 bp, Homo sapiens
aaaaggaagttatctggactcaagagggtcacagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagatttagaaggtgatgtaatgatgtattcattgtgcttatgatgtattcttagtcataactgagtgaaggaaatgggaaatttgcattatttctttgttctgatatgaataataacatatttcataataattcaaggtaaaaagggatatctatggatttccctaggtaggagataacaagtatgtaccattactgaatattaaatccttctttaccatagctacagttaagtaggtgtatctcagaaacctaaggtagttttaaatgtagtgaaattg

SEQ ID NO: 1652 - DNA, 8457 bp, Homo sapiens
gagagacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccgggcgtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatcggcaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgcgccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctcc

SEQ ID NO: 1653 - DNA, 7844 bp, Homo sapiens
gagagacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccgggcgtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatcggcaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgcgccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagcgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctcc

SEQ ID NO: 1654 - DNA, 2158 bp, Homo sapiens
actcattcataaaacgcttgttataaaagcagtggctgcggcgcctcgtactccaaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 1655 - DNA, 1614 bp, Homo sapiens
agtggctctactttcagaagaaagtgtctctcttcctgcttaaacctctgtctctgacggtccctgccaatcgctctggtcgaccccaacacactaggaggacagacacaggctccaaactccactaaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcccacatttgtccccttcttgg

SEQ ID NO: 1656 - DNA, 1398 bp, Homo sapiens
atgaatcctccaagccaggagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccacgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcccacatttgtccccttcttgg

SEQ ID NO: 1657 - DNA, 2180 bp, Homo sapiens
cttcaatatcttgcatgttacagatttcactgctcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacaca

SEQ ID NO: 1658 - DNA, 795 bp, Homo sapiens
ggagccaccagcagaacctcttcaatatcttgcatgttacagatttcactgctcccaccagcttggagacaacatgtggttcttgacaactctgctcctttggggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtca

SEQ ID NO: 1659 - DNA, 2829 bp, Homo sapiens
cctccacaggcccgccccggggcctgggccaactgaaaccgcgggaggaggaagcgcggaatcaggaactggccggggtccgcaccgggcctgagtcggtccgaggccgtcccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgctccctccaccgctgcagctcattccggaggtgcagaagcccctgcatgagcagctgtggtaccacggggccatcccgagggcagaggtggctgagctgctggtgcactctggggacttcctggtgcgggagagccagggcaagcaggagtacgtgctgtcggtgctgtgggatggtctgccccggcacttcatcatccagtccttggataacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctgggacccccttctcaagctggtggcctctgcaggcctaggtgcagctcctcagcggctccagctcatatgctgacagctcttcacagtcctggactcctgccaccagcatccacactgccggcaggatgcagcgccgtgtcctctctgtgtccctgctgctgccagggcttcctcttccgggcagaaacaataaaaccacttgtgcccactgaa

SEQ ID NO: 1660 - DNA, 2302 bp, Homo sapiens
atgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgctccctccaccgctgcagctcattccggaggtgcagaagcccctgcatgagcagctgtggtaccacggggccatcccgagggcagaggtggctgagctgctggtgcactctggggacttcctggtgcgggagagccagggcaagcaggagtacgtgctgtcggtgctgtgggatggtctgccccggcacttcatcatccagtccttggataacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctggg

SEQ ID NO: 1661 - DNA, 2133 bp, Homo sapiens
ggaatcaggaactggccggggtccgcaccgggcctgagtcggtccgaggccgtcccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgaacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgagaagcagcccatctacatcgtcatggagcttgtgcagggggtcctccccacctgcagggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgagg

SEQ ID NO: 1662 - DNA, 2327 bp, Homo sapiens
aaaccgcgggaggaggaagcgcggaatcaggaactggccggggtccgcaccgggcctgagtcggtccgaggccgtcccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgaacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctgggacccccttctcaagctggtggcctctgcaggcctaggtgcagctcctcagcggctccagctcatatgctgacagctcttcacagtcctggactcctgccaccagcatccacactgccggcaggatgca

SEQ ID NO: 1663 - DNA, 485 bp, Homo sapiens
agtgtgaagaactgggcctattgtgtcttcctgggctgaagtgatctggtcgccacaggctatagggctgaggcctaaggtggagggaggcctgactgaatcaagatgacttcttgtggggagcctgagtcccaaatggaaaactccacgcctgtccgctccccaacccctgccccttgatttccccaggtctcccttgggacaggaagcccctgcctgggggtaggaggatggggacaaaaccactaggatctgtatccgagaagcagtctctgttcgggatatttacttggaaattttattcaaatggaagctggcgcctgagcctctccttagggaattccgtgagaacagcactatgggcttctcttccgagctgtgcagcccccagggccacggggtcctgcagcaaatgcaggaggccgagcttcgtctactggagggcatgagaaagtggatggcccagcgggtcaagagtgacaggg

SEQ ID NO: 1664 - DNA, 544 bp, Homo sapiens
agctggggcaggcttggcctgtcgaggacctgggcaagggtgtccctgtaaggggtggtgggtggaagggcctggggagggaggctccaggttggctcctgttcccgaacgtgcggaggagaccctgacgctaaggaagcaatgagggccagtccccaggccaggctgctgctgggtacccatggctgcgtaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagac

SEQ ID NO: 1665 - DNA, 2266 bp, Homo sapiens
atgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgaacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctggg

SEQ ID NO: 1666 - DNA, 2085 bp, Homo sapiens
atgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgaacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacggccgctactcctccgaaagcgacgtgtggagctttggcatcttgctctgggagaccttcagcctgggggcctccccctatcccaacctcagcaatcagcagacacgggagtttgtggagaaggggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtga

SEQ ID NO: 1667 - DNA, 587 bp, Homo sapiens
gagtcggtccgaggccgtcccaggagcagctgcccgtgcgggtacctctagccccggggcctggaggagcggtgggagctgggggcgcggcaggcaggggcagagcaggcgttccgagggccagagacccacccagaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacggg

SEQ ID NO: 1668 - DNA, 2461 bp, Homo sapiens
ccaggagcagctgcccgtgcggaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggagatggctgcagctgctgcccgcatccagcctgaggctgagtaccaaggcttcctgcgacagtatgggtccgcacctgacgtcccaccctgtgtcacgttcgatgagtcactgcttgaggagggtgaaccgctggagcctggggagctccagctgaacgagctgactgtggagagcgtgcagcacacgctgacctcagtgacagatgagctggctgtggccaccgagatggtgttcaggcggcaggagatggttacgcagctgcaacaggagctccggaatgaagaggagaacacccacccccgggagcgggtgcagctgctgggcaagaggcaagtgctgcaagaagcactgcaggggctgcaggtagcgctgtgcagccaggccaagctgcaggcccagcaggagttgctgcagaccaagctggagcacctgggccccggcgagcccccgcctgtgctgctcctgcaggatgaccgccactccacgtcgtcctcggagcaggagcgagaggggggaaggacacccacgctggagatccttaagagccacatctcaggaatcttccgccccaagttctcgctccctccaccgctgcagctcattccggaggtgcagaagcccctgcatgagcagctgtggtaccacggggccatcccgagggcagaggtggctgagctgctggtgcactctggggacttcctggtgcgggagagccagggcaagcaggagtacgtgctgtcggtgctgtgggatggtctgccccggcacttcatcatccaggctcacgccccctcagaatggaggctgctgaccccgggtcccctgccctgcagaacctgtaccgactggaaggggaaggctttcctagcattcctttgctcatcgaccacctactgagcacccagcagcccctcaccaagaagagtggtgttgtcctgcacagggctgtgcccaaggacaagtgggtgctgaaccatgaggacctggtgttgggtgagcagattggacgggggaactttggcgaagtgttcagcggacgcctgcgagccgacaacaccctggtggcggtgaagtcttgtcgagagacgctcccacctgacctcaaggccaagtttctacaggaagcgaggatcctgaagcagtacagccaccccaacatcgtgcgtctcattggtgtctgcacccagaagcagcccatctacatcgtcatggagcttgtgcaggggggcgacttcctgaccttcctccgcacggagggggcccgcctgcgggtgaagactctgctgcagatggtgggggatgcagctgctggcatggagtacctggagagcaagtgctgcatccaccgggacctggctgctcggaactgcctggtgacagagaagaatgtcctgaagatcagtgactttgggatgtcccgagaggaagccgatggggtctatgcagcctcagggggcctcagacaagtccccgtgaagtggaccgcacctgaggcccttaactacgggggccgtctgccctgcccagagctgtgtcctgatgccgtgttcaggctcatggagcagtgctgggcctatgagcctgggcagcggcccagcttcagcaccatctaccaggagctgcagagcatccgaaagcggcatcggtgaggctgggacccccttctcaagctggtggcctctgcaggcc

SEQ ID NO: 1669 - DNA, 1096 bp, Homo sapiens
aaaccgcgggaggaggaagcgcggaatcaggaactggccggggtccgcaccgggcctgagtcggtccgaggccgtcccaggagcagctgcccgtgcgggtacctctagccccggggcctggaggagcggtgggagctgggggcgcggcaggcaggggcagagcaggcgttccgagggccagagacccacccagaacagcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcaggtgggtctctatgggactctggtgggtgctggctgtatctgccttctccttcctctcctgggggccctctggggcagtggctggagatctggcaggccaatgcttgggagccattgtgcccccctccctgcctcccccatctgtgctgtatagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggctaaggacaagtatgtgcgcagcctgtggaagctctttgctcaccacaaccgctatgtgctgggcgtgcgggctgcgcagctacaccaccagcaccaccaccagctcctgctgcccggcctgctgcggtcactgcaggacctgcacgaggagatggcttgcatcctgaaggagatcctgcaggaatacctggagattagcagcctggtgcaggatgaggtggtggccattcaccgggag

SEQ ID NO: 1670 - DNA, 587 bp, Homo sapiens
ggaatcaggaactggccggggtccgcaccgggcctgagtcggtccgaggccgtcccaggagcagctgcccgtgcggcactatgggcttctcttccgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcagtcctgggctgagatcaccagccaaactgagggcctgagccgcttgctgcggcagcacgcagaggatctgaactcagggcccctgagcaagctgagcctgctcatccgggaacggcagcagcttcgcaagacctacagcgagcagtggcagcagctgcagcaggagctcaccaagacccacagccaggacattgagaagctgaagagccagtaccgagctctggcacgggacagtgcccaagccaagcgcaagtaccaggaggccagcaaagacaaggaccgtgacaaggctaag

SEQ ID NO: 1671 - DNA, 2780 bp, Homo sapiens
aagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaa

SEQ ID NO: 1672 - DNA, 2598 bp, Homo sapiens
aaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttg

SEQ ID NO: 1673 - DNA, 1469 bp, Homo sapiens
ggctctgtgttcctgggcctgctgctggctgtccagagtaggggttgcttagagctgtgtgcatccctgcgggtggtgtgggagtgggcggttgtctaaaggcaggtcccctctactgataaacaaggaccggagatagacctagaggctgacattcttggctcccccagcctacaccccccccacctcgatttcccacagagccctagggacgggtagccagctctgtggcatggtatctggaggcaggccagcaacctgatgtgcatgccacggcccgtccctctccccactcagagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaa

SEQ ID NO: 1674 - DNA, 3660 bp, Homo sapiens
gaaaaaatactgttggcagcagcacaatgtttgggctaagacctggtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggaaaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtga

SEQ ID NO: 1675 - DNA, 2582 bp, Homo sapiens
gactgcaaaaatatgaatgcaccatgccgccacattatctccattcctccagtgcccgcctgacactggccctgaatcagggctggagggggcaggcatttctcatttactaaagtgctggatgcagcccttgaggttcggcagaagcagaaagctgcgtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtggatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaacccttaccaacagcttttcccaggagaccatttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaa

SEQ ID NO: 1676 - DNA, 298 bp, Homo sapiens
agactcttgggggattccttagtgagtgagttcactgctcaaagaagggctttgccacttctgcagggaagccagccacgggccagcagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagc

SEQ ID NO: 1677 - DNA, 550 bp, Homo sapiens
agagagccgggctactctgagaagaagacaccaagtggattctgcttcccctgggacagcactgagcgagtgtggagagaggtacagccctcggcctacaagctctttagagcacaattaaagaagatcaggtctggctgttgctcggcttcctttctcgttgtgactatgagagggaacacagagttgtgtggactcagtcatggcaattaccctcttctttgtcatcacttcttcctgaaatacctgagagaagacaaagtgagtggacataggaagaagatggccatctactagccaaggagagaggcttggaacaagtccttctttcatagcctcagaaggaaccaaccctgctgacaccttgatcttggacttccagccttcaacacttcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatcctt

SEQ ID NO: 1678 - DNA, 683 bp, Homo sapiens
tacagtgcttgtccttagcctttctgtgggcataccagtgtcagctgcacttgtaggggcccaagtgcctcatgacccactcggcagccttcctctccaggatccccaaggctaggaggccaacctactaacagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggt

SEQ ID NO: 1679 - DNA, 777 bp, Homo sapiens
tacagtgcttgtccttagcctttctgtgggcataccagtgtcagctgcacttgtaggggcccaagtgcctcatgacccactcggcagccttcctctccaggatccccaaggctaggaggccaacctactaacagcagcctgcctgcagctgtcctggtagaacagtgtggacattgcagaagctgtcactgccccagaaagaaagcaccccagagccaaggcaaagagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagctcagtgcggaaagcgtgggggaggtgtatataaagagtaccgagactggccagtacttggccatggacaccgacgggcttttatacggctcacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggt

SEQ ID NO: 1680 - DNA, 695 bp, Homo sapiens
tctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacacagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaa

SEQ ID NO: 1681 - DNA, 2193 bp, Homo sapiens
agggagctaaccagcagccaccacctcgagctctctccttgccttgcatcgggtcttacccttccagtatgttccttctgatgagacaatttccagtgccgagagtttcagtacaatgtggaaatggatactgacacattgtgcctcagcctttccccacctgcccggctgctgctgctgctgctttttgttgctgttcttggtgtcttccgtccctgtcacctgccaagcccttggtcaggacatggtgtcaccagaggccaccaactcttcttcctcctccttctcctctccttccagcgcgggaaggcatgtgcggagctacaatcaccttcaaggagatgtccgctggagaaagctattctctttcaccaagtactttctcaagattgagaagaacgggaaggtcagcgggaccaagaaggagaactgcccgtacagcatcctggagataacatcagtagaaatcggagttgttgccgtcaaagccattaacagcaactattacttagccatgaacaagaaggggaaactctatggctcaaaagaatttaacaatgactgtaagctgaaggagaggatagaggaaaatggatacaatacctatgcatcatttaactggcagcataatgggaggcaaatgtatgtggcattgaatggaaaaggagctccaaggagaggacagaaaacacgaaggaaaaacacctctgctcactttcttccaatggtggtacactcatagaggaaggcaacgtttgtggatgcagtagaaccaatggctcttttgccaagaatagtggatattcttcatgaagacagtagattgaaaggcaaagacacgttgcagatgtctgcttgcttaaaagaaagccagcctttgaaggtttttgtattcactgctgacatatgatgttcttttaattagttctgtgtcatgtcttataatcaagatataggcagatcgaatgggatagaagttattcccaagtgaaaaacattgtggctgggttttttgttgttgttgtcaagtttttgtttttaaacctctgagatagaacttaaaggacatagaacaatctgttgaaagaacgatcttcgggaaagttatttatggaatacgaactcatatcaaagacttcattgctcattcaagcctaatgaatcaatgaacagtaatacatgcaagcatttactggaaagcacttgggtcatatcatatgcacaaccaaaggagttctggatgtggtctcatggaataattgaatagaatttaaaaatataaacatgttagtgtgaaactgttctaacaatacaaatagtatggtatgcttgtgcattctgccttcatccctttctatttctttctaagttatttatttaataggatgttaaatatcttttggggttttaaagagtatctcagcagctgtcttctgatttatcttttctttttattcagcacaccacatgcatgttcacgacaaagtgtttttaaaacttggcgaacacttcaaaaataggagttgggattagggaagcagtatgagtgcccgtgtgctatcagttgacttaatttgcacttctgcagtaataaccatcaacaataaatatggcaatgctgtgccatggcttgagtgagagatgtctgctatcatttgaaaacatatattactctcgaggcttcctgtctcaagaaatagaccagaaggccaaattcttctctttcaatacatcagtttgcctccaagaatatactaaaaaaaggaaaattaattgctaaatacatttaaatagcctagcctcattatttactcatgatttcttgccaaatgtcatggcggtaaagaggctgtccacatctctaaaaaccctctgtaaattccacataatgcatctttcccaaaggaactatcaaagaatttggtatgaagcgcaactctcccaggggcttaaactgagcaaatcaaatatatactggtatatgtgtaaccatatacaaaaacctgttctagctgtatgatctagtctttacaaaaccaaataaaacttgttttctgtaaatttaaagagctttacaaagttccataatgtaaccatatcaaaattcattttgttagagcaggtatagaaaagagtacataagagtttaccaatcatcatcacattgtattccactaaataaatacataagcc

SEQ ID NO: 1682 - DNA, 1131 bp, Homo sapiens
aattagacagagctagaggcgccggcggaggctgcggccgcaacagccgcggcgaggaagggacctggcagcccccgagctcggtgcaaaggcatcgcgctctctcctcgctcccctgctcccccacccccttctctgcccctttcaccctccctctccctggcgttcccagcagcctagggtttcagatgtcccaccgccggttgaccccctcccccctcttctccacccctgcaaatgaggtttgaccagcagaggcagagcccacctctggcttagaatcactgacatttagactccaggcttcaacctgtttacaagcggactttccaaaggaagggggtgggagatagggccatacaaaacaccagccgccgtcccccaaaacaaaaagtgactttcggcagccttcaaatcggcaggcaccactaaaaacagaaaggaagagagggaagaaaacaacggcgactgggcagctgcctccacttctgacaactccaaagggatatacttgtagaagtggctcgcaggctggggctccgcagagagagaccagaagacctttttggcatctaacatggtgaagaaaggagtaaagaagagaacaaagtaactcctgggggagcgaagagcgctggtgaccaacaccaccaacgccaccaccagctcctgctgctgcggccacccacgtccaccatttaccgggaggctccagaggcgtaggcagcggatccgagaaaggagcgaggggagtcagccggcttttccgaggagttatggatgttggtgcattcacttctggccagatccgcgcccagagggagctaaccagcagccaccacctcgagctctctccttgccttgcatcgggtcttacccttccagtatgttccttctgatgagacaatttccagtgccgagagtttcagtacaatgtggaaatggatactgacacattgtgcctcagcctttccccacctgcccggctgctgctgctgctgctttttgttgctgttcttggtgtcttccgtccctgtcacctgccaagcccttggtcaggacatggtgtcaccagaggccaccaactcttcttcctcctccttctcctctccttccagcgcgggaaggcat

SEQ ID NO: 1683 - DNA, 6775 bp, Homo sapiens
cggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcatttgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcactggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttacactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaatttatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgactacctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctcattttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctccca

SEQ ID NO: 1684 - DNA, 5467 bp, Homo sapiens
tagctccctctcatgaccattgaatactatacaagcctccttttattctcgctgttgtattcaactaacagctcactggctaagttttaattgcttccaatgaggtcagcaaaggtatttatcgaaaagccctgaataaaaggctcacacacacacacaagcacacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacaatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtaaaaaattgtaaaactggttgtacaatcatgatgttagtaacagtaatttttttcttaaattaatttacccttaagagtatgttagatttgattatctgataatgattatttaaatattcctatctgcttataaaatggctgctataataataataatacagatgttgttatataaggtatatcagacctacaggcttctggcaggatttgtcagataatcaagccacactaactatggaaaatgagcagcattttaaatgctttctagtgaaaaattataatctacttaaactctaatcagaaaaaaaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataaatcctcaaagtaaaattgagaaatctttaagtttttttcaagtaacataatctatctttgtataattcatatttgggaatatggcttttaataatgttcttcccacaaataatcatgcttttttcctatggttacagcattaaactctattttaagttgtttttgaactttattgttttgttatttaagtttatgttatttataaaaaaaaaaccttaataagctgtatctgtttcatatgcttttaattttaaaggaataacaaaactgtctggctcaacggcaagtttccctcccttttctgactgacactaagtctagcacacagcacttgggccagcaaatcctggaaggcagacaaaaataagagcctgaagcaatgcttacaatagatgtctcacacagaacaatacaaatatgtaaaaaatctttcaccacatattcttgccaattaattggatcatataagtaaaatcattacaaatataagtatttacaggattttaaagttagaatatatttgaatgcatgggtagaaaatatcatattttaaaactatgtatatttaaatttagtaattttctaatctctagaaatctctgctgttcaaaaggtggcagcactgaaagttgttttcctgttagatggcaagagcacaatgcccaaaatagaagatgcagttaagaataaggggccctgaatgtcatgaaggcttgaggtcagcctacagataacaggattattacaaggatgaatttccacttcaaaagtctttcattggcagatcttggtagcactttatatgttcaccaatgggaggtcaatatttatctaatttaaaaggtatgctaaccactgtggttttaatttcaaaatatttgtcattcaagtccctttacataaatagtatttggtaatacatttatagatgagagttatatgaaaaggctaggtcaacaaaaacaatagattcatttaattttcctgtggttgacctatacgaccaggatgtagaaaactagaaagaactgcccttcctcagatatactcttgggagagagcatgaatggtattctgaactatcacctgattcaaggactttgctagctaggttttgaggtcaggcttcagtaactgtagtcttgtgagcatattgagggcagaggaggacttagtttttcatatgtgtttccttagtgcctagcagactatctgttcataatcagttttcagtgtgaattcactgaatgtttatagacaaaagaaaatacacactaaaactaatcttcattttaaaagggtaaaacatgactatacagaaatttaaatagaaatagtgtatatacatataaaatacaagctatgttaggaccaaatgctctttgtctatggagttatacttccatcaaattacatagcaatgctgaattaggcaaaaccaacatttagtggtaaatccattcctggtagtataagtcacctaaaaaagacttctagaaatatgtactttaattatttgtttttctcctatttttaaatttattatgcaaattttagaaaataaaatttgctctagttacacacctttagaattctagaatattaaaactgtaaggggcctccatccctcttactcatttgtagtctaggaaattgagattttgatacacctaaggtcacgcagctgggtagatatacagctgtcacaagagtctagatcagttagcacatgctttctactcttcgattattagtattattagctaatggtctttggcatgtttttgttttttatttctgttgagatatagcctttacatttgtacacaaatgtgactatgtcttggcaatgcacttcatacacaatgactaatctatactgtgatgatttgactcaaaaggagaaaagaaattatgtagttttcaattctgattcctattcaccttttgtttatgaatggaaagctttgtgcaaaatatacatataagcagagtaagccttttaaaaatgttctttgaaagataaaattaaatacatgagtttctaacaattagaaaagaaaaaattaaaacatgaaatgataacaaaagtaaacaaaagatactttcaaagcagtgaacaaaacattttgacataagccataatataaattataatataaaaaataaaaaccatagtataaattgtcagcctttgagttggctacaaattcaatttaatgacagaagagaagggatgctggaggtaaattcttagggtttctatctcatagagtttgctcttctggttctctagactgccaaagaacataaagatgtgcgaggggacctagctgtagtaaaagcaatcctataacaagaaaaactctaaaacagtgccccttacgattttctactgaaatttctctaatagtagaggtgtaaaataagaagttagagaataatgcaaagggggcccaccacagacggaacatttcttttctcttaagactcatgtgatttttgcatcttactccataatatatttgtggttgcgttaatatgacaatgtctgcaattaaacaccagtaagcaaaattgatacatcagaatgacttgcagggcttatcatgcagtttggtttacatccctactccactgccatttacttgagcgtgaatgagacacaaaagattatttgcctcccataatccaactttacacataaataacacaaggctaaagaaaaccagaactcaaattcaccacgcataggagtgataacaaaaatatttaacagtcagtatgggtgattactggccaatcagaatacatcactgatacatcgaaatggatgcaggccactatgactaacttgtgggtatcatttctatgatcaccctaaaacagagttgggaaaatatctattaactggtctctctggtttgaattctcaatatgtatcttaatatgaaatagctcattaaaacttcatgtgtaactatttcagcattgttgtcagctactctttattccacttctgtacagtatttattcaaccaagctgctgctttcaatgaaggtcacttgttccttcagggacacatatactcccacctatcctttaattttgaatggtttgtcaggaaaatttactttctcttgagttgaaaaacttgacaggaagcaagaaataatacagtcctagcctctttccaataacatctgatttctccattctcaaactacacttctcaaggaaccagatatttactctcatctgggaagatgcctcttatgttttccttttacttcctggttatcatgtggttgcattttccaagttcttatcattgaatttatgagagcctatcaaaatttattttctttcatttatattctaataattgaaatgtgagatgaaaataacatttcacttatgaaaaacccttctcttgatgaatccttccatgtgttagttatctattgctgtgtaacaaattaaaacttaatggcttgaaacaaa

SEQ ID NO: 1685 - DNA, 1123 bp, Homo sapiens
acacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacaatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggacttttcttctctctctctctctctctctctctatat

SEQ ID NO: 1686 - DNA, 1179 bp, Homo sapiens
gaatagtctaccccccttgcactctacctgacacagctgcagcctgcaattcactcgcactgcctgggattgcactggatccgtgtgctcagaacaaggtgaacgcccagctgcagccatgaagatctgtagcctcaccctgctctccttcctcctactggctgctcaggtgctcctggtggaggggaaaaaaaaagtgaagaatggacttcacagcaaagtggtctcagaacaaaaggacactctgggcaacacccagattaagcagaaaagcaggcccgggaacaaaggcaagtttgtcaccaaagaccaagccaactgcagatgggctgctactgagcaggaggagggcatctctctcaaggttgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaaccagagtgtgcagaaaggattttccagaatccagtcttaagctagtcagctccactctatttgggaacacaaagcccaggaaggagaaaacagagatgtcccccagggagcacatcaaaggcaaagagaccaccccctctagcctagcagtgacccagaccatggccaccaaagctcccgagtgtgtggaggacccagatatggcaaaccagaggaagactgccctggagttctgtggagagacttggagctctctctgcacattcttcctcagcatagtgcaggacacgtcatgctaatgaggtcaaaagagaacgggttcccttaagagatgtcatgtcgtaagtccctctgtatactttaaagctctctacagtccccccaaaatatgaacttttgtgcttagtgagtgcaacgaaatatttaaacaagttttgtattttttgcttttgtgttttggaatttgccttatttttcttggatgcgatgttcagaggctgtttcctgcagcatgtatttccatggcccacacagctatgtgtttgagcagcgaagagtctttgagctgaatgagccagagtgataatttcagtgcaacgaactttctgctgaattaatggtaataaaactctgggtgtttttcagaaatacattc

SEQ ID NO: 1687 - DNA, 1359 bp, Homo sapiens
gaatcattgcactccctactagagcggatgtgatgagggaaaaggagaactcagcactttccctgcaggaaccggctccctcggaggggcgtggctgggaggagctgtgagtaacgtgccacagtgttgtaaaaacccagtgagtgttataaaaacccagtcagcctggctcctgttgaatagtctaccccccttgcactctacctgacacagctgcagcctgcaattcactcgcactgcctgggattgcactggatccgtgtgctcagaacaaggtgaacgcccagctgcagccatgaagatctgtagcctcaccctgctctccttcctcctactggctgctcaggtgctcctggtggaggggaaaaaaaaagtgaagaatggacttcacagcaaagtggtctcagaacaaaaggacactctgggcaacacccagattaagcagaaaagcaggcccgggaacaaaggcaagtttgtcaccaaagaccaagccaactgcagatgggctgctactgagcaggaggagggcatctctctcaaggttgagtgcactcaattggaccatgaattttcctgtgtctttgctggcaatccaacctcatgcctaaagctcaaggatgagagagtctattggaaacaagttgcccggaatctgcgctcacagaaagacatctgtagatattccaagacagctgtgaaaaccagagtgtgcagaaaggattttccagaatccagtcttaagctagtcagctccactctatttgggaacacaaagcccaggaaggagaaaacagagatgtcccccagggagcacatcaaaggcaaagagaccaccccctctagcctagcagtgacccagaccatggccaccaaagctcccgagtgtgtggaggacccagatatggcaaaccagaggaagactgccctggagttctgtggagagacttggagctctctctgcacattcttcctcagcatagtgcaggacacgtcatgctaatgaggtcaaaagagaacgggttcccttaagagatgtcatgtcgtaagtccctctgtatactttaaagctctctacagtccccccaaaatatgaacttttgtgcttagtgagtgcaacgaaatatttaaacaagttttgtattttttgcttttgtgttttggaatttgccttatttttcttggatgcgatgttcagaggctgtttcctgcagcatgtatttccatggcccacacagctatgtgtttgagcagcgaagagtctttgagctgaatgagccagagtgataatttcagtgcaacgaactttctgctgaattaatggtaataaaactctgggtgtttttcagaaatacattcaaa

SEQ ID NO: 1688 - DNA, 4132 bp, Homo sapiens
tctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctg

SEQ ID NO: 1689 - DNA, 513 bp, Homo sapiens
gagtacctggacctgtcggcgcctttcgagcagtactccccgggtggccaggacacccccagctccagctcctcaggggacgactccgtgtttgcccacgacctgctggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgttgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggaccccgggcagggagctgggcccgacatgcggcctctgcctttgcaccacgggacatcacagggtctcggcccctcccacacccaaagctga

SEQ ID NO: 1690 - DNA, 4293 bp, Homo sapiens
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagtcctggatcagtgagagtgtggaggccgacgtgcgcctccgcctggccaatgtgtcggagcgggacgggggcgagtacctctgtcgagccaccaatttcataggcgtggccgagaaggccttttggctgagcgttcacgggccccgagcagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgg

SEQ ID NO: 1691 - DNA, 3951 bp, Homo sapiens
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgg

SEQ ID NO: 1692 - DNA, 4287 bp, Homo sapiens
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgg

SEQ ID NO: 1693 - DNA, 4217 bp, Homo sapiens
gcggcgtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacagcaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgct

SEQ ID NO: 1694 - DNA, 3122 bp, Homo sapiens
cgctcgcggccacgccgccgtcgcgggtacattcctcgctcccggccgaggagcgctcgggctgtctgcggaccctgccgcgtgcaggggtcgcggccggctggagctgggagtgaggcggcggaggagccaggtgaggaggagccaggtgagcaggaccctgtgctgggcgcggagtcacgcaggctcgaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctgggtc

SEQ ID NO: 1695 - DNA, 2928 bp, Homo sapiens
acattcctcgctcccggccgaggagcgctcgggctgtctgcggaccctgccgcgtgcaggggtcgcggccggctggagctgggagtgaggcggcggaggagccaggtgaggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccaggtactgggcgcatcccccacctcacatgtgacagcctgactccagcaggcagaaccaagtctcccactttgcagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctggg

SEQ ID NO: 1696 - DNA, 3559 bp, Homo sapiens
ccctgtatgtggcaccaacagcatgtgccttgtgtgtgtgtgtgtccgtatgtgtgtgtgtgtatgcgtgtgtgtgtgtgtgtgtgttggccactgtcgtgtgcactaaatgctgtgtgtgtgacatgccccaagagtgtggcatttgccctgggtgtggcatccgcagcatgtggctgtgtgggtgtcaaggagtggtggctccttcagcatgcgttgcaaagtgcttgtgccctgcatgtgcggtgtgttctttgtacacaggaggctgcctcagatggggctgcggggtctgctgacctctgccctctgcccacagagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactcccctccagcaacgatgatgaggaccccaagtcccatagggacccctcgaataggcacagttacccccagcaaggtcagtaggtctccaaggacttgtgtccccgctgctgctcatctgatcactgagaagaggaggcctgtgtgggaacacacggtcattctaggggccttcccctgccctccagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccaggtgagcacctgaagggccaggagatgctgcgagatgcccctctgggccagcagtgggggctgtggcctgttgggtggtcagtctctgttggcctgtggggtctggcctggggggcagtgtgtggatttgtgggtttgagctgtatgacagcccctctgtgcctctccacacgtggccgtccatgtgaccgtctgctgaggtgtgggtgcctgggactgggcataactacagcttcctccgtgtgtgtccccacatatgttgggagctgggagggactggggtgcacggggcggccagtctcaccactgaccagtttgtctgtctgtgtgtgtccatgtgcgagggcagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaagctctgtgtgcctggg

SEQ ID NO: 1697 - DNA, 2418 bp, Homo sapiens
agtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccaggtactgggcgcatcccccacctcacatgtgacagcctgactccagcaggcagaaccaagtctcccactttgcagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatg

SEQ ID NO: 1698 - DNA, 2638 bp, Homo sapiens
acattcctcgctcccggccgaggagcgctcgggctgtctgcggaccctgccgcgtgcaggggtcgcggccggctggagctgggagtgaggcggcggaggagccaggtgaggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctca

SEQ ID NO: 1699 - DNA, 770 bp, Homo sapiens
gtcgcgggtacattcctcgctcccggccgaggagcgctcgggctgtctgcggaccctgccgcgtgcaggggtcgcggccggctggagctgggagtgaggcggcggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcgg

SEQ ID NO: 1700 - DNA, 709 bp, Homo sapiens
attcctcgctcccggccgaggagcgctcgggctgtctgcggaccctgccgcgtgcaggggtcgcggccggctggagctgggagtgaggcggcggaggagccaggtgaggaggagccagagacggggtttcaccgtgttagccaggatgttctcgatctcctgacctcgtgatccgcccacctcggcctcccaaagtgctgggattacaggtgtgaaccatcgcgcccagccgacttgtagttttttaaaactctgctggaagatgaaggttgaagagccgagggagaggatgtttccagaggcccatgcaagagatggccatgacctgccttgagaaggggcaggggaagccagatggactggaagtggagtggcagtgaccaaggaggaggaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagaga

SEQ ID NO: 1701 - DNA, 594 bp, Homo sapiens
tcttcgcgccggcggcagagatgagggacctgaggccccgaaaagttcagtcacttagtgcccgggggcctccagcgcgagtgcgggaggctgaaggagaacccaggactgtctgatgcctaaggcaggccctccattcccacgtggggggtggtcggtcagcggtcagcagccatgggtgactcgactaaggactctgatatcagggcagcctggggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatc

SEQ ID NO: 1702 - DNA, 552 bp, Homo sapiens
acattcctcgctcccggccgaggagcgctcgggctgtctgcggaccctgccgcgtgcaggggtcgcggccggctggagctgggagtgaggcggcggaggagccaggtgaggaggagccaggtgagcaggaccctgtgctgggcgcggagtcacgcaggctcgagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcacct

SEQ ID NO: 1703 - DNA, 8527 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatatt

SEQ ID NO: 1704 - DNA, 8708 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaa

SEQ ID NO: 1705 - DNA, 8435 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaa

SEQ ID NO: 1706 - DNA, 7918 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatatt

SEQ ID NO: 1707 - DNA, 7999 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctggatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatatt

SEQ ID NO: 1708 - DNA, 8905 bp, Homo sapiens
cggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaa

SEQ ID NO: 1709 - DNA, 7846 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcc

SEQ ID NO: 1710 - DNA, 8025 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatatt

SEQ ID NO: 1711 - DNA, 7898 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaa

SEQ ID NO: 1712 - DNA, 8524 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatatt

SEQ ID NO: 1713 - DNA, 8103 bp, Homo sapiens
cccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagtatttgaatagta

SEQ ID NO: 1714 - DNA, 2388 bp, Homo sapiens
cggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactga

SEQ ID NO: 1715 - DNA, 7759 bp, Homo sapiens
cccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcca

SEQ ID NO: 1716 - DNA, 7762 bp, Homo sapiens
cggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaa

SEQ ID NO: 1717 - DNA, 7952 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaa

SEQ ID NO: 1718 - DNA, 3720 bp, Homo sapiens
ctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactg

SEQ ID NO: 1719 - DNA, 705 bp, Homo sapiens
ggtgagtagtggcgcgcggcggctcggagtacctctgccgccgcgcgcatcggctcagcatgcccgtctctgtctcctcagggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaa

SEQ ID NO: 1720 - DNA, 747 bp, Homo sapiens
ccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttgggtaaggaaatggaatactgaagggcccttcactgcctttgctcctcccatgttatgcccagcgtttgatgggtagcagagagaacaaaaaacaccacaaggctatttttccccctgcattctttctgtattgagtatcctttcagtgttattagtgtatgctttgaatgtaaaaattggtcaccctaaggaaaggaattggcatgtgtatgttcccagttcaactcatggagatggcagctgtttaaatgtttttctatgtagtttataaattaaaactgaattgaggactatggaaatgtaggccaaatttgtagtgccaacattttagttctttggaaataagactcttaat

SEQ ID NO: 1721 - DNA, 976 bp, Homo sapiens
gcccgtcgcgccgcccgcccgctcagcgtccgccgccgccatgggagtgcaggtggaaaccatctccccaggagacggtgagtagtggcgcgcggcggctcggagtacctctgccgccgcgcgcatcggctcagcatgcccgtctctgtctcctcagggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctt

SEQ ID NO: 1722 - DNA, 1622 bp, Homo sapiens
gtcgcgcgccgtgtggggcgcgcacgcagggctgggcgtgagggggcgtgcgcgtgcgcaggcgacgcgccgaggtactaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctca

SEQ ID NO: 1723 - DNA, 279 bp, Homo sapiens
atgggagtgcaggtggaaaccatctccccaggagacgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatga

SEQ ID NO: 1724 - DNA, 2296 bp, Homo sapiens
aaaggaagtgcctccggcgcaagtggcattgagggacttgtagtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaccaaaa

SEQ ID NO: 1725 - DNA, 776 bp, Homo sapiens
gagcgagcttaggaccgcctgcccggggcaaccccgaaccaagctttagccgccgaggccgcgtgtcccaaaggccaggtgagaccccatgggaagcgcctccgggagcgacggggtccgcttggcgctgggggccgtggggagccggggtctggagtgcgcgggattcgcagtcaagaggtcccgccacttttccccctgtgagccttgggccagtcgcgtaagctccgagcctctctttcctccattgtagaaaagcgtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgcc

SEQ ID NO: 1726 - DNA, 7084 bp, Homo sapiens
gcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatacgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaa

SEQ ID NO: 1727 - DNA, 2668 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctgaactgtatacatcaacgtcaccatcgtcatcgtcatcatcaccattgtcatcatcatcatcatcgtcatcatcatcatcatcatagctatcatcattatcatcatcatcatcatcatcatcatagctaccatttattgaaaactattatgtgtcaacttcaaagaacttatcctttagttggagagccaagacaatcataacaataacaaatggccgggcatggtggctcacgcctgtaatcccagcactttgggaggccaaggcaggtggatcatttgaggtcaggagttcaagaccagcctgaccaagatggtgaaatgctgtctctattaaaaatacaaaattagccaggcatggtggctcatgcctgtaatgccagctactcgggaggctgagacaggagaatcacttgaacccaggaggcagaggttgcagggagccgagatcgtgtactgcactccagcctgggcaacaagagcgaaactccgtctcaaaaaacaaataaataaataaataaataaacagacaaaattcactttttattctattaaacttaacatacatgc

SEQ ID NO: 1728 - DNA, 1911 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagcttccaccagctaacagttctttcatgttgccacctacaagcttctcttccaactacttccatttccttccgtga

SEQ ID NO: 1729 - DNA, 1927 bp, Homo sapiens
actttaagtcttttccttttggtcttggaggaacagtgctcagcttttgatctctgtgattctgatagagaagctgtttctggaattacaaagtttgcaaacttgacagcaaaatttctggaaagccttttctatgaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatacgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttc

SEQ ID NO: 1730 - DNA, 338 bp, Homo sapiens
gagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagaattgtcaaactttgagtgccttcatccttgctctcaggaatagaattctacctcatcggatctcatgtgccaaatgggtttcatgttaacttggaaaaaatgccgacggaaggagaggacctgaaactgtcttgcacagttaacaagttcttatacagagacgttacttggattttactgcgg

SEQ ID NO: 1731 - DNA, 2968 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctgaactgtatacatcaacgtcaccatcgtcatcgtcatcatcaccattgtcatcatcatcatcatcgtcatcatcatcatcatcatagctatcatcattatcatcatcatcatcatcatcatcatagctaccatttattgaaaactattatgtgtcaacttcaaagaacttatcctttagttggagagccaagacaatcataacaataacaaatggccgggcatggtggctcacgcctgtaatcccagcactttgggaggccaaggcaggtggatcatttgaggtcaggagttcaagaccagcctgaccaagatggtgaaatgctgtctctattaaaaatacaaaattagccaggcatggtggctcatgcctgtaatgccagctactcgggaggctgagacaggagaatcacttgaacccaggaggcagaggttgcagggagccgagatcgtgtactgcactccagcctgggcaacaagagcgaaactccgtctcaaaaaacaaataaataaataaataaataaacagacaaaattcactttttattctattaaacttaacatacatgc

SEQ ID NO: 1732 - DNA, 1275 bp, Homo sapiens
acagagttactaattttgacagggaactgtaccgttttctcccctcagggattttcatcttaatggatcatccccctgcccccatgcttggataaagtgggctggaggcctggaaaaatctctggtgttcatgttgaaactcaaatactcttaaaaatgaactctgatctacttgttgattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatacgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcaca

SEQ ID NO: 1733 - DNA, 358 bp, Homo sapiens
gagagcatcactcagcgcatggcaataatagaaggaaagaataagcttccaccagctaacagttctttcatgttgccacctacaagcttctcttccaactacttccatttccttccgtgactctaaacggatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcgg

SEQ ID NO: 1734 - DNA, 1035 bp, Homo sapiens
tctctggctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctacc

SEQ ID NO: 1735 - DNA, 627 bp, Homo sapiens
tctctggctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgtagagacggtgtttcaccgtgtcagccaggatggtctcgatctcctgacctcgtga

SEQ ID NO: 1736 - DNA, 1076 bp, Homo sapiens
ggggcatgagggtccgagacttgttcttctgtcccttccaagacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctgcggagccttaaacaacgcagtgagacagacatctatcatcccattttacaggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctacca

SEQ ID NO: 1737 - DNA, 5857 bp, Homo sapiens
aggccagccggcgcccgcgcggacactttcagccccgagccgcggccgctcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggagatcgtgatccttgtcggtaccggcgtcatcgctgtcttcttctgggtcctcctcctcctcatcttctgtaacatgaggaggccggcccacgcagacatcaagacgggctacctgtccatcatcatggaccccggggaggtgcctctggaggagcaatgcgaatacctgtcctacgatgccagccagtgggaattcccccgagagcggctgcacctggggagagtgctcggctacggcgccttcgggaaggtggtggaagcctccgctttcggcatccacaagggcagcagctgtgacaccgtggccgtgaaaatgctgaaagagggcgccacggccagcgagcaccgcgcgctgatgtcggagctcaagatcctcattcacatcggcaaccacctcaacgtggtcaacctcctcggggcgtgcaccaagccgcagggccccctcatggtgatcgtggagttctgcaagtacggcaacctctccaacttcctgcgcgccaagcgggacgccttcagcccctgcgcggagaagtctcccgagcagcgcggacgcttccgcgccatggtggagctcgccaggctggatcggaggcggccggggagcagcgacagggtcctcttcgcgcggttctcgaagaccgagggcggagcgaggcgggcttctccagaccaagaagctgaggacctgtggctgagcccgctgaccatggaagatcttgtctgctacagcttccaggtggccagagggatggagttcctggcttcccgaaagtgcatccacagagacctggctgctcggaacattctgctgtcggaaagcgacgtggtgaagatctgtgactttggccttgcccgggacatctacaaagaccccgactacgtccgcaagggcagtgcccggctgcccctgaagtggatggcccctgaaagcatcttcgacaaggtgtacaccacgcagagtgacgtgtggtcctttggggtgcttctctgggagatcttctctctgggggcctccccgtaccctggggtgcagatcaatgaggagttctgccagcggctgagagacggcacaaggatgagggccccggagctggccactcccgccatacgccgcatcatgctgaactgctggtccggagaccccaaggcgagacctgcattctcggagctggtggagatcctgggggacctgctccagggcaggggcctgcaagaggaagaggaggtctgcatggccccgcgcagctctcagagctcagaagagggcagcttctcgcaggtgtccaccatggccctacacatcgcccaggctgacgctgaggacagcccgccaagcctgcagcgccacagcctggccgccaggtattacaactgggtgtcctttcccgggtgcctggccagaggggctgagacccgtggttcctccaggatgaagacatttgaggaattccccatgaccccaacgacctacaaaggctctgtggacaaccagacagacagtgggatggtgctggcctcggaggagtttgagcagatagagagcaggcatagacaagaaagcggcttcagctgtaaaggacctggccagaatgtggctgtgaccagggcacaccctgactcccaagggaggcggcggcggcctgagcggggggcccgaggaggccaggtgttttacaacagcgagtatggggagctgtcggagccaagcgaggaggaccactgctccccgtctgcccgcgtgactttcttcacagacaacagctactaagcagcatcggacaagacccccagcacttgggggttcaggcccggcagggcgggcagagggctggaggcccaggctgggaactcatctggttgaactctggtggcacaggagtgtcctcttccctctctgcagacttcccagctaggaagagcaggactccaggcccaaggctcccggaattccgtcaccacgactggccagggccacgctccagctgccccggcccctccccctgagattcagatgtcatttagttcagcatccgcaggtgctggtcccggggccagcacttccatgggaatgtctctttggcgacctcctttcatcacactgggtggtggcctggtccctgttttcccacgaggaatctgtgggtctgggagtcacacagtgttggaggttaaggcatacgagagcagaggtctcccaaacgccctttcctcctcaggcacacagctactctccccacgagggctggctggcctcacccacccctgcacagttgaagggaggggctgtgtttccatctcaaagaaggcatttgcagggtcctcttctgggcctgaccaaacagccaactagcccctggggtggccaccagtatgacagtattatacgctggcaacacagaggcagcccgcacacctgcgcctgggtgttgagagccatcctgcaagtctttttcaacagaacttcacagactgttagagctgctgagaagaatttgctttccgaattcagcctggaaggcgcccagggacagctgtactgagtctagatgactctgacccccgccccaggtcaaggccagcagagcagtcagtgcctctggagaaggcccttgctctcccacctggcccagactccgaggagcctgggtctggagctgccggtctggttcttccctttagagcccggatctgccacctgcggcccctcccaagccgtgaaccagctcatgagagatgaacactgtgggatccactcaggaaggctcggggctggcacaaaggaccacccagcattgccctgtgccacccagcactcagtggacattctggggacctgccttcagccttttcctgccctgtgcctgacatcagcaccctggctggtcagaatgccgccctcccagaggagcagccgagagatcccctgaaggctggaggcattctgctcaggacccctatcccagctcacagtgcccaaccatctcaccaggagaaagagccacatccccacgttaggaccacggagactgaccaccaccctgaccccccaaacccacgcaccagacgcttgcaggacaggcgccgcgcagcgggcaggggcttgcccggccgaccctcccctccccacctcccccactgcgcgttactccaggatatgccgagtgcacgtataaggtcatcttcgtcgtccccgtggacctcccccttcctctgcacgtcgtccaacgtgggactggcgtgtcaggcttccctgggaggatctggaggttgttctctgcagagaaccagcctggctcctggcgcgcacctctgctcccttctcctcactacccacccacgcatgtaccgggaaaaaaactactatgcccttctagaccatgttctgagaaaagatcgaaaatatttaacaagagataataataaatctgatgccggtctttgtgtgtgttgcgga

SEQ ID NO: 1738 - DNA, 2932 bp, Homo sapiens
aggccagccggcgcccgcgcggacactttcagccccgagccgcggccgctcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggagatcgtgatccttgtcggtaccggcgtcatcgctgtcttcttctgggtcctcctcctcctcatcttctgtaacatgaggaggccggcccacgcagacatcaagacgggctacctgtccatcatcatggaccccggggaggtgcctctggaggagcaatgcgaatacctgtcctacgatgccagccagtgggaattcccccgagagcggctgcacctggggagagtgctcggctacggcgccttcgggaaggtggtggaagcctccgctttcggcatccacaagggcagcagctgtgacaccgtggccgtgaaaatgctgaaaggtgtggggtcagcgggcggaaggggcagcctagctggtgaggagcagcagctcggggtgggccggtgggacggcaactcgggaagggagactgaggctggaagccagtctcatccgagattctacagggaggctgcgggcttcagagccgagggaccacccgaacccccttcagtggggccggcaggatgtcctgggggcccttag

SEQ ID NO: 1739 - DNA, 4292 bp, Homo sapiens
aggccagccggcgcccgcgcggacactttcagccccgagccgcggccgctcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggagatcgtgatccttgtcggtaccggcgtcatcgctgtcttcttctgggtcctcctcctcctcatcttctgtaacatgaggaggccggcccacgcagacatcaagacgggctacctgtccatcatcatggaccccggggaggtgcctctggaggagcaatgcgaatacctgtcctacgatgccagccagtgggaattcccccgagagcggctgcacctggggagagtgctcggctacggcgccttcgggaaggtggtggaagcctccgctttcggcatccacaagggcagcagctgtgacaccgtggccgtgaaaatgctgaaagagggcgccacggccagcgagcaccgcgcgctgatgtcggagctcaagatcctcattcacatcggcaaccacctcaacgtggtcaacctcctcggggcgtgcaccaagccgcagggccccctcatggtgatcgtggagttctgcaagtacggcaacctctccaacttcctgcgcgccaagcgggacgccttcagcccctgcgcggagaagtctcccgagcagcgcggacgcttccgcgccatggtggagctcgccaggctggatcggaggcggccggggagcagcgacagggtcctcttcgcgcggttctcgaagaccgagggcggagcgaggcgggcttctccagaccaagaagctgaggacctgtggctgagcccgctgaccatggaagatcttgtctgctacagcttccaggtggccagagggatggagttcctggcttcccgaaagtgcatccacagagacctggctgctcggaacattctgctgtcggaaagcgacgtggtgaagatctgtgactttggccttgcccgggacatctacaaagaccccgactacgtccgcaagggcagtgcccggctgcccctgaagtggatggcccctgaaagcatcttcgacaaggtgtacaccacgcagagtgacgtgtggtcctttggggtgcttctctgggagatcttctctctgggggcctccccgtaccctggggtgcagatcaatgaggagttctgccagcggctgagagacggcacaaggatgagggccccggagctggccactcccgccatacgccgcatcatgctgaactgctggtccggagaccccaaggcgagacctgcattctcggagctggtggagatcctgggggacctgctccagggcaggggcctgcaagaggaagaggaggtctgcatggccccgcgcagctctcagagctcagaagagggcagcttctcgcaggtgtccaccatggccctacacatcgcccaggctgacgctgaggacagcccgccaagcctgcagcgccacagcctggccgccaggtattacaactgggtgtcctttcccgggtgcctggccagaggggctgagacccgtggttcctccaggatgaagacatttgaggaattccccatgaccccaacgacctacaaaggctctgtggacaaccagacagacagtgggatggtgctggcctcggaggagtttgagcagatagagagcaggcatagacaagaaagcggcttcaggtagctgaagcagagagagagaaggcagcatacgtcagcattttcttctctgcacttataagaaagatcaaagactttaagactttcgctatttcttctactgctatctactacaaacttcaaagaggaaccaggaggacaagaggagcatgaaagtggacaaggagtgtgaccactgaagcaccacagggaggggttaggcctccggatgactgcgggcaggcctggataatatccagcctcccacaagaagctggtggagcagagtgttccctgactcctccaaggaaagggagacgccctttcatggtctgctgagt

SEQ ID NO: 1740 - DNA, 4140 bp, Homo sapiens
actttcagccccgagccgcggccgctcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggagatcgtgatccttgtcggtaccggcgtcatcgctgtcttcttctgggtcctcctcctcctcatcttctgtaacatgaggaggccggcccacgcagacatcaagacgggctacctgtccatcatcatggaccccggggaggtgcctctggaggagcaatgcgaatacctgtcctacgatgccagccagtgggaattcccccgagagcggctgcacctggggagagtgctcggctacggcgccttcgggaaggtggtggaagcctccgctttcggcatccacaagggcagcagctgtgacaccgtggccgtgaaaatgctgaaagagggcgccacggccagcgagcaccgcgcgctgatgtcggagctcaagatcctcattcacatcggcaaccacctcaacgtggtcaacctcctcggggcgtgcaccaagccgcagggccccctcatggtgatcgtggagttctgcaagtacggcaacctctccaacttcctgcgcgccaagcgggacgccttcagcccctgcgcggagaagtctcccgagcagcgcggacgcttccgcgccatggtggagctcgccaggctggatcggaggcggccggggagcagcgacagggtcctcttcgcgcggttctcgaagaccgagggcggagcgaggcgggcttctccagaccaagaagctgaggacctgtggctgagcccgctgaccatggaagatcttgtctgctacagcttccaggtggccagagggatggagttcctggcttcccgaaagtgcatccacagagacctggctgctcggaacattctgctgtcggaaagcgacgtggtgaagatctgtgactttggccttgcccgggacatctacaaagaccccgactacgtccgcaagggcagtgcccggctgcccctgaagtggatggcccctgaaagcatcttcgacaaggtgtacaccacgcagagtgacgtgtggtcctttggggtgcttctctgggagatcttctctctgggggcctccccgtaccctggggtgcagatcaatgaggagttctgccagcggctgagagacggcacaaggatgagggccccggagctggccactcccgccatacgccgcatcatgctgaactgctggtccggagaccccaaggcgagacctgcattctcggagctggtggagatcctgggggacctgctccagggcaggggcctgcaagaggaagaggaggtctgcatggccccgcgcagctctcagagctcagaagagggcagcttctcgcaggtgtccaccatggccctacacatcgcccaggctgacgctgaggacagcccgccaagcctgcagcgccacagcctggccgccaggtattacaactgggtgtcctttcccgggtgcctggccagaggggctgagacccgtggttcctccaggatgaagacatttgaggaattccccatgaccccaacgacctacaaaggctctgtggacaaccagacagacagtgggatggtgctggcctcggaggagtttgagcagatagagagcaggcatagacaagaaagcggcttcagaggaaccaggaggacaagaggagcatgaaagtggacaaggagtgtgaccactgaagcaccacagggaggggttaggcctccggatgactgcgggcaggcctggataatatccagcctcccacaagaagctggtggagcagagtgttccctgactcctccaaggaaagggagacgccctttcatggtctgctg

SEQ ID NO: 1741 - DNA, 3638 bp, Homo sapiens
ggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggcggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctgatttagaagaggaatcagaaagctgggacaactctgaggctgaagaggaggagaaagcccctgtgttgccagagagtacagaagggcgggagctgacccagggcccggcagagtcctcctctctctcaggctgtgggagctggcagccccggaagctgccagtcttcaagtccctccggcacatgaggcaggtcctgggtgccccttctttccgcatgctggcctggcacgttctcatggggaaccaggtgatctggaaaagcagagacgtggacctcgtccagtcagcttttgaagtacttcggaccatgcttcccgtgggctgcgtccgcatcatcccatacagcagccagtacgaggaggcctatcggtgcaacttcctggggctcagcccgcacgtgcagatccccccccacgtgctctcctcagagtttgctgtcatcgtggaggtccacgcagccgcacgttccaccctccaccctgtggggtgtgaggatgaccagtctctcagcaagtacgagtttgtggtgaccagtgggagccctgtagctgcagaccgagtgggccccaccatcctgaataagattgaagcggctctgaccaaccagaacctgtctgtggatgtggtggaccagtgcctcgtctgcctcaaggaggagtggatgaacaaagtgaaggtgctttttaagttcaccaaggtggacagtcgacccaaagaggacacacagaagctgctgagcatcctgggtgcgtccgaggaggacaatgtcaagctgctgaagttctggatgactggcctgagcaagacctacaagtcacacctcatgtccacggtccgcagccccacagcctcggagtctcggaactgacccgtcacacacacctgcctaaagacagggatggctgtccacaggatcctccagccccgtgagagggactgtcccttgagtttctcaactgctggaaggagctgtgtcccagcaaggaagggaaaccatcagggctgggctcggccctgtcaggtttggggcctgtgtgcttcccagactctccctccagccgttggaatcgctgaagatggcaatgaaaggcggagggatgatgggctctctctgtgttcaaactccttggagagacgactaggaggacagcttgcctcccaggccccttgtggacttagactcaaaacccgcaggagaaacaggtccgactcagtatgcagtcgcaataacatgtctgctcccgaggttaacattcaagcgtttctactttgaaattcagcaagagtttctgggccttatgtttgagggtaccttttgctgcagttgtgaatattcagtacattgccagctcttggtcactgagtgattgagttagggctccgcaagagactttggggagtgaagtggatctcttcctcatcttttggtcctctgaaatgtgtgttctgaagccatggggctcgtcttctggggtgttcccctgcaggtgctggtgaaggtaacctggggcttaatgatggagtccctgatcatttttgcacaagacaggttgctgaggggtcggcaagcatctgacttgcccaatcccctggatatggtgagccccgccatgcttttattctgtatcgcttttgtctttattgctgctttcaacatttacgtttggttacagttaactattttcggagtgtggtgattgaagacaatttcatcatcccactgtacttttttttttgagagggagtttcactcttgttgcccaggctggagtgcaatggcacgatcttggctcactgcaacctctgcctcctgggttcaagcaattctcctgcctcagcctccagagtagctggaactacaggtgcccgccactatgcccagctaatttttgtattttttagtagagacggggtttcaccgtgttggccgggctggtctcaaactcctgacctcaggtgatccacccacctcagcctcccaaagtgctgggattacaagcgtgagccactgtgcctggcccttttttttttttttttttttttttttaaagagatggcatcttgctatgtcgtccaggctggtcttgaactcctgagttcaagcagtcctcctgcttcaacatacagctacaggtaccccccactatacatttttaataaggattcatggctcagagggattttctgatggttttgctgatttgtttctagtttttttgtgtttatatttaacatgaagaccaagtttatataactaggtatctgtataatgcaacaacattggaacacaataaagatgtatttttgtaaa

SEQ ID NO: 1742 - DNA, 3359 bp, Homo sapiens
tttaagtggaatcctacagtgtttatccgtttgtgaccagtgtagatcatttcgtgtaatgtccttcagtttcagccgtgccgtagcttgtggcagggtttccttcctttttaaggccatgtgacattccagtcccaccttgctaaagcagtttacctggtcactggggtgactctggagctcccctctggcctcactgcctgtgcttggtcatgttggctagctgtcctcccttctccacctctgagtctacaagggctgcactccacggaggtcccatgcgtcagccccgaccgcagcgcttggctctgctgctgtgtcccgtccccgtgaaggctcagcaggcactcactgggccttctcccctgctcactgctccgcactctgcaccccacccgcactgtgcgtcttcaccctgcctggcctgggccactgtcccttcctgctcagatcagtcagcagggtgcctcagcttgttccccacctccaccctggccccctgccatcttttctgcacatgggcatgagtgaacctattcaagtgaaattcacattttctcatgtctcatcagaacccccaaagcctccccagtctctgataacacatccagggtctttcggtggcctggaggagctataagatctgcttcctacagcctccaccctgtctgctgctgctctttggacaccggaccttacacacccctcagacagtacagcacccaccctgcccttcaactcttgcttggccccgtaagccagtccttccaggctcctgcctcctctggtcattccctgcgtgggcctctcgcaggaagcagttttcctgtgtcccccgccgaccccctgcaggaggtaagctgcatgagggcagtatcatgttgcctagcaccttggcccacatggagcaggtgccaagcagatatgtattgggtggaggaccctctccctgtggccttttatctatttgttctcacagggtttgccaggtttggctgcagttcatgtcacttgaggacattcctttccagcgccgttggctttgtggctgtggctctgtcacagctccagctgtgctatcattggtccacattgtcccctcccctatttgctgtgactcccatgggaagatcctatctctgttcctctcgcactggggcaaagcagtgctggcagggggctggggaactggcgggtggcctctcctgggcaggaagtccatggcacccaggtgctccctgtgctccagaggggctggggaggtttcatggagtcaataggcattggcaagctgacatgtcccctgtcccacgcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtgagccttgtggccacagagcctgtctctgtgggagcccacatgctcccaggtgctctgggtgggctcggagccagcattgcacagggaggcaggcactggtcctctctcagggcggacccgcagatcagcacagcacagggtacaggacgcctcccttgtccagaattgcgggaggagtcatgttggacttgctgagcattttctgattgagtgctagcttttgcactttaagcaccgaacttttattatttgtcctttctttattattattgttttcttttttccttcttttgtgtcagggtctcgctctgtcgtccagactggagtgcagtggtgccgtcatggttcactgcaacctcaaactcctgggctcaagcgatcctcccgccttagcctcccaggtggctgggaccactggtgtgtgccaccatgctcaactggggtttgttttttgttgttgttaagacagagtctcactcggttgcccaggctggagtgcagtggtgcaatctcggcttactgcaacctccaccctgggtttaagtgattcttctgtctcagctatcctgagtagctgggacaacaggcgtgtgccaccatgcccggctaattttttgtatttttagtagagaagagatttcaccatgttggccgagctggtcttgaactcctgaccttgtgatttgcccgcctcggcctcccgaagtgctgggattacaggtgggagccactgtgccccacctttttaaaatttttttgtagagatgaggtctcagtatgttgcccaggttggtctcgaactcaagcaatcctctggctcatcctcccaaagcactaggattacaggtgtgagccgccatgcccagccatgtgtgtctattcttgatggatgtattcctaagataggaagcatttctaggttaggtggttcattgcatcaacatcacctttttttattatctcagtcctcattccaagtctcagtgatgatcccgtgctgctctcagcctgctgaggtgtggatgatttcttcctaaactacgtcgctgctgctgttgctcttgactctgagctcaggtctttgttacaaagaattcgtcgttcagttactaaacttccttgtcattggtgtccacccagttcgacacaccaagctcccttactgttctcattcagtgtggctgtgtgcctgccctcaactgtcctctccttttaatttcctaccgctggtctgctagcaggcagctcggcatgtctgttagaattgtgtgttaaggaagagtaagtatgtaatgaggagggactgaaatcctcttataagaataaagtacgtggggctgggcatggtggcccactcctgtaatcccagccctttgggaggccaaggccggcagatcacctgaggtcaggagttcgagaccagcctggccaacatggtgaaaccccctctctaaaaaaaatacaaaaaaattagccaggcgtggtggcacactcttacaatcccagctactcaggaggctgaggcaggagaattgcttgaacccaggagacggaggttgcagtgggccaggatcacaccactgcattccagcctgggtgacaagagcgagactccatctc

SEQ ID NO: 1743 - DNA, 1692 bp, Homo sapiens
ggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggcggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctggtgaggcaggggtgctgttgccggggccttggcccggatggccgtggggcggtaccagctgtctgctctcctggcaggaatcgctgagggagggaaacgcggctctgaatcagcccagaacgagccttcgggaagctcaccctccgatctcggtgtgattgttgtgattgttgtgatttcctgtctcgtttgccttgaccgccatgtgaaagaatctgttccccagctaggtggggaaaattcacaggtgggctgtctgtagagagaactggctgattaaaggcttctcgtcccgattttgtgatagccaagtgcttggcctggtcgacggtctttgctcctttacaaataaagtgttctgtttca

SEQ ID NO: 1744 - DNA, 2523 bp, Homo sapiens
gagtcacgcgcctgggtgtcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggcggggctgggacccagagcgggaccccggctgccgagtccaggtgtcccgcgggcctcgatttggggagcagaaaacgccaggtcttcaagggtgtctgccaccaccatgcctgacccatttggcagcagcctcgtgtgtggtggtctggtgtggacggtggaagcgtgattctgctgagtgtcagtgtgaccactcgtgctcagccgtatctcagcaggaggacaggtgccggagcagctcgtgcagctaagcagccaactgcagaaacgtcaggcctgttgcagtctccaaggcaccatgaatgccatcgtggctctctgccacttctgcgagctccacggcccccgcactctcttctgcacggaggtgctgcacgccccacttcctcaaggggatgggaatgaggacagtcctggccagggtgagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtgagccttgtggccacagagcctgtctctgtgggagcccacatgctcccaggtgctctgggtgggctcggagccagcattgcacagggaggcaggcactggtcctctctcagggcggacccgcagatcagcacagcacagggtacaggacgcctcccttgtccagaattgcgggaggagtcatgttggacttgctgagcattttctgattgagtgctagcttttgcactttaagcaccgaacttttattatttgtcctttctttattattattgttttcttttttccttcttttgtgtcagggtctcgctctgtcgtccagactggagtgcagtggtgccgtcatggttcactgcaacctcaaactcctgggctcaagcgatcctcccgccttagcctcccaggtggctgggaccactggtgtgtgccaccatgctcaactggggtttgttttttgttgttgttaagacagagtctcactcggttgcccaggctggagtgcagtggtgcaatctcggcttactgcaacctccaccctgggtttaagtgattcttctgtctcagctatcctgagtagctgggacaacaggcgtgtgccaccatgcccggctaattttttgtatttttagtagagaagagatttcaccatgttggccgagctggtcttgaactcctgaccttgtgatttgcccgcctcggcctcccgaagtgctgggattacaggtgggagccactgtgccccacctttttaaaatttttttgtagagatgaggtctcagtatgttgcccaggttggtctcgaactcaagcaatcctctggctcatcctcccaaagcactaggattacaggtgtgagccgccatgcccagccatgtgtgtctattcttgatggatgtattcctaagataggaagcatttctaggttaggtggttcattgcatcaacatcacctttttttattatctcagtcctcattccaagtctcagtgatgatcccgtgctgctctcagcctgctgaggtgtggatgatttcttcctaaactacgtcgctgctgctgttgctcttgactctgagctcaggtctttgttacaaagaattcgtcgttcagttactaaacttccttgtcattggtgtccacccagttcgacacaccaagctcccttactgttctcattcagtgtggctgtgtgcctgccctcaactgtcctctccttttaatttcctaccgctggtctgctagcaggcagctcggcatgtctgttagaattgtgtgttaaggaagagtaagtatgtaatgaggagggactgaaatcctcttataagaataaagtacgtggggctgggcatggtggcccactcctgtaatcccagccctttgggaggccaaggccggcagatcacctgaggtcaggagttcgagaccagcctggccaacatggtgaaaccccctctctaaaaaaaatacaaaaaaattagccaggcgtggtggcacactcttacaatcccagctactcaggaggctgaggcaggagaattgcttgaacccaggagacggaggttgcagtgggccaggatcacaccactgcattccagcctgggtgacaagagcgagactccatctc

SEQ ID NO: 1745 - DNA, 757 bp, Homo sapiens
cgcgcctgggtgtcggcggggctgcgggaccgcgagtgagtgtggtcgctcctggttctgccagctcccctgagagcctgaacccgggcttgagagcctcgccaccccgggtgacatccctgccgtgggcttgggggctctgggtgtgattccgccggtccgggtcccgcagcgaccacctacccagcgcagtcaggggcggggctgggacccagagcgggaccccggctgccgagtccaggtgtcccgcgggcctcgatttggggagcaggcggaagaagaggaaggtggcattcagatgaacagtcggatgcgtgcgcacagccccgcagagggggccagcgtcgagtccagcagcccggggcccaaaaagtcggacatgtgcgagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtctgccctggccgtgaaggccccatcttcttcggagatgagcagcacggctttgtgttcagccacaccttcttcatcaaggacagcctggccaggggcttccagcgctggtacagcatcatcaccatcatgatggaccggatctacctcatcaactcctggcccttcctgctggggaaggtccggggaatcatcgatgagctccagggcaaggcgctcaag

SEQ ID NO: 1746 - DNA, 2862 bp, Homo sapiens
cgcgcggccgcccgtcgcttcgcacagggctggatggttgtattgggcagggtggctccaggatgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgcgaagtttaatgatccacaagtgtatatatgaaattctcctccttccttgcccccctctctttcttccctctttcccctccagacattctagtttgtggagggttatttaaaaaaacaaaaaaggaagatggtcaagtttgtaaaatatttgtttgtgctttttccccctccttacctgaccccctacgagtttacaggtctgtggcaatactcttaaccataagaattgaaatggtgaagaaacaagtatacactagaggctcttaaaagtattgaaagacaatactgctgttatatagcaagacataaacagattataaacatcagagccatttgcttctcagtttacatttctgatacatgcagatagcagatgtctttaaatgaaatacatgtatattgtgtatggacttaattatgcacatgctcagatgtgtagacatcctccgtatatttacataacatatagaggtaatagataggtgatatacatgatacattctcaagagttgcttgaccgaaagttacaaggaccccaacccctttgtcctctctacccacagatggccctgggaatcaattcctcaggaattgccctcaagaactctgcttcttgctttgcagagtgccatggtcatgtcattctgaggtcacataacacataaaattagtttctatgagtgtataccatttaaagaatttttttttcagtaaaagggaatattacaatgttggaggagagataagttatagggagctggatttcaaaacgtggtccaagattcaaaaatcctattgatagtggccattttaatcattgccatcgtgtgcttgtttcatccagtgttatgcactttccacagttggacatggtgttagtatagccagacgggtttcattattatttctctttgctttctcaatgttaatttattgcatggtttattctttttctttacagctgaaattgctttaaatgatggttaaaattacaaattaaattgttaatttttatcaatgtgattgtaattaaaaatattttgatttaaataacaaaaataataccagattttaagccgtggaaaatgttcttgatcatttgcagttaaggactttaaataaatcaaatgttaacaaaa

SEQ ID NO: 1747 - DNA, 1792 bp, Homo sapiens
aaagcccgaggatcctttcagcagcacagagcagagaccgcgctccccaggagggggatcggctggatgaggagggaccggctggggctgagcacgtcctccaacaggcgctgaccggtgtgaacaaaagcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcctagctcccgggactggggggtttgtctggcatagccatgctggtagcaagagagaaaaaatcaacagcaaacaaaaccacacaaaccaaaccgtcaacagcataataaaatcccaacaactatttttatttcatttttcatgcacaacctttcccccagtgcaaaagactgttactttattattgtattcaaaattcattgtgtatattactacaaagacaaccccaaaccaatttttttcctgcgaagtttaatgatccacaagtgtatatatgaaattctcctccttccttgcccccctctctttcttccctctttc

SEQ ID NO: 1748 - DNA, 1683 bp, Homo sapiens
cgcgctctctcgctctcagggcccccctcgctcccccggccgcagtccgtgcgcgagggcgccggcgagccgtctcggaagcagcatgcaggcgcgctactccgtgtccgaccccaacgccctgggagtggtgccctacctgagcgagcagaattactaccgggctgcgggcagctacggcggcatggccagccccatgggcgtctattccggccacccggagcagtacagcgcggggatgggccgctcctacgcgccctaccaccaccaccagcccgcggcgcctaaggacctggtgaagccgccctacagctacatcgcgctcatcaccatggccatccagaacgcgcccgagaagaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacctagcggacgcccccaaggaggccgagaagaaggtggtgatcaagagcgaggcggcgtccccggcgctgccggtcatcaccaaggtggagacgctgagccccgagagcgcgctgcagggcagcccgcgcagcgcggcctccacgcccgccggctcccccgacggctcgctgccggagcaccacgccgcggcgcccaacgggctgcctggcttcagcgtggagaacatcatgaccctgcgaacgtcgccgccgggcggagagctgagcccgggggccggacgcgcgggcctggtggtgccgccgctggcgctgccctacgccgccgcgccgcccgccgcctacggccagccgtgcgctcagggcctggaggccggggccgccgggggctaccagtgcagcatgcgagcgatgagcctgtacaccggggccgagcggccggcgcacatgtgcgtcccgcccgccctggacgaggccctctcggaccacccgagcggccccacgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatactgacgtgtcccgggacctcccctccccggcccgctccggcttcgcttcccagccccgacccaaccagacaattaaggggctgcagagacgcaaaa

SEQ ID NO: 1749 - DNA, 5722 bp, Homo sapiens
gcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctctattgtaagcttcccactgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggcttggtgtctttcttttctaattatgcagaataagctctttattaggaattttttgtgaagctattaaatacttgagttaa

SEQ ID NO: 1750 - DNA, 7308 bp, Homo sapiens
gggaggaggaggaatgtggaaggtggcggcgcgcgagctgacaggcggttcctcgggcgggctgcggcgacggcccgagcgcttctccttcgccgaggttgcgcgccccctcctcgccgtgccccgggcccgcgcgggatcgtgcgtcgtcccgccgcgtccctgaagggaaggaagcgaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaaggaaaaaaaaaaaaaacaaaaaagtcctgttttgctttgcagaacaaatgaacttacaggtgagcattaagcttgcagtgagaaatgtgcgaagagtaaaaacccaagtcaatgctgaggcagttctaacttcactgttttcctaaatacacatccttgattattttcagccttgctatataatctgatctgctagaagtgtatgagtgagaggcaatagcatacaaactgattttttaaatataagcttaggttgtaattgtacaagtgactcaatggaagtacaaaatagggcagttttaacttttttttctgcttctatggatttcattttgttgtgttttcaaaaagttatggtgctgtataggtgctttctgtttaacctggaaagtgtgattatattcgttaccttctttggtagacggaatagttgggaccacctttggtacataagaaattggtataacgatgctctgattagcacagtatatgcatacttctccaaagtgatatatgaagactcttttctttgcataaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtcaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactctatctta

SEQ ID NO: 1751 - DNA, 7341 bp, Homo sapiens
gcgcgaggccgtcgattcgctcgcggctccatcgcggcctggccggggggcggtgtctgctgcgccaggttcgctggccgcacgtcttcaggtcctcctgttcctgggaggcgggcgcggcaggactgggaggtggcggcagcgggcgaggactcgccgaggacggggctccggcccgggataaccaactctccttctctcttctttggtgcttccccaggcggcggcggcggcgcccgggagccggagccttcgcggcgtccacgtccctcccccgctgcaccccgccccggcgcgagaggagagcgcgagagccccagccgcgggcgggcgggcggcgaagatggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaaggaaaaaaaaaaaaaacaaaaaagtcctgttttgctttgcagaacaaatgaacttacaggtgagcattaagcttgcagtgagaaatgtgcgaagagtaaaaacccaagtcaatgctgaggcagttctaacttcactgttttcctaaatacacatccttgattattttcagccttgctatataatctgatctgctagaagtgtatgagtgagaggcaatagcatacaaactgattttttaaatataagcttaggttgtaattgtacaagtgactcaatggaagtacaaaatagggcagttttaacttttttttctgcttctatggatttcattttgttgtgttttcaaaaagttatggtgctgtataggtgctttctgtttaacctggaaagtgtgattatattcgttaccttctttggtagacggaatagttgggaccacctttggtacataagaaattggtataacgatgctctgattagcacagtatatgcatacttctccaaagtgatatatgaagactcttttctttgcataaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtcaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactct

SEQ ID NO: 1752 - DNA, 1619 bp, Homo sapiens
gatgtctctgaagaaaccaatgccttcttcagatccttatgggaaatttaggggacttttggattacacagtgttgccttttgctgattctaagatagagccttccaattaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgtcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccg

SEQ ID NO: 1753 - DNA, 2553 bp, Homo sapiens
gagtggacagtctccacaaggtaaacatggtttggaagggctgaagcggacgtagggtacaaaatttaagaaattaccagttacttctgactggcacggcacctctgaaatacttttttaaagtttgaaatcctttcctggaaggggccgccctggaaccttttggcttaaagtatatgatgctcggaaaacaaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaacagaactctaaaaagtatgcaaaatcttccttgtacagggtggtgagccgcctgccagtggaggacagcacccctcagcaccacccaccctcattcagagcacaccgtgagcccccgtcggccattctgtggtgttttaatattgcgatggtttatgggacgttttaagtgttgttcttgtgtttgttttcctttgactttctgagtttttcacatgcattaacttgcggtatttttctgttaaaatgttaaccgtccttcccctagcaaatttaaaaacagaaagaaaatgttgtaccagttaccattccgggttcgagcatcacaagcttttgagcgcatggaactccataaactaacaaattacataaactaaagggggattttctttcttcttttgtttggtagaaaattatccttttctaaaaactgaacaatggcacaattgtttgctatgtgcacccgtccaggacagaaccgtgcataggcaaaaggagtggagcacagcgtccggcccagtgtgtttccggttctgagtcagggtgatctgtggacgggaccccagcaccaagtctacgggtgccagatcagtagggcctgtgatttcctgtcagtgtcctcagctaatgtgaacagtgttggtctgctggttagaaactagaatattgatattttcaggaaagaaatcagctcagctctccactcattgccaaatgtcactaaagggtttagttttaaggagaaagaaaagg

SEQ ID NO: 1754 - DNA, 444 bp, Homo sapiens
atgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtga

SEQ ID NO: 1755 - DNA, 1634 bp, Homo sapiens
gaattgcagtccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacaggtaaagactgcatttcgtcattacccagaccctcccgtgggcctcaggaaagaggctgcactctcagaatggggatgcacaaaaacaccttcaccagcatccttgggtggtggctgcaaaggacaaagagctggaggggagaaaaccctggcccttgagtactgtattcccagcctcccagtctcttccaactctcctgcctcttcactctcttcttccaagccagtgcccccagcccaccaccacctttctccagtctttcctgcggtggtgctcctccagaatccaatgttcacaaagcagaccttctgtcatgcacaacttcttgtttaaaaggtcaaccccaacttaacttaaaggtgtgacatggcccttaggctcaagtctgtctgcaaagccctgtaaaccagctttctctgcctccctaacacgcccccgggcaaactcctctgctttcactgagtggactcttctcttcagttgctatttggtaaattgcccttcatgtttccctttatgttcggctcctaggaagctcaggccacagggaaaagtcaaggcttgatagaattaatctttgtcttaatgatgactaactgttgagagatcataggtttaagactctggtagaaagatagctatagccaatttccttgtcaaaatgcttctactccaaatttttatgcagtgtctaacgagctcatgcctagatctatctggcaatctatattatccctcctagtctcagttcacatagtagactgctggaatgactgagggtgatgtttggcctgtaaacaaaaagtgttaaaga

SEQ ID NO: 1756 - DNA, 1033 bp, Homo sapiens
cctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacagatcctgaattccagcaaaagagctattgccaaccagtttgaagaccgccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgcaa

SEQ ID NO: 1757 - DNA, 601 bp, Homo sapiens
cctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaaggtaccgtgactggatcacatggagccccaggatttttagtacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcac

SEQ ID NO: 1758 - DNA, 1081 bp, Homo sapiens
tccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacagatgtttttcagatcctgaattccagcaaaagagctattgccaaccagtttgaagaccgccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgcaa

SEQ ID NO: 1759 - DNA, 3851 bp, Homo sapiens
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatac

SEQ ID NO: 1760 - DNA, 1074 bp, Homo sapiens
ggccctctgcggccgccgtagctccccggcagaaacccggaagtggaactctgagccattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagagtaagaagaaaaagagcaaagataagaaaagaaaaagagaagaagatgaagaaacccagcttgatattgttggaatctggtggacagtaacaaactttggtgaaatttcaggaaccatagccattgaaatggataagggaacctatatacatgcactcgacaatggtctttttaccctgggagctccacacaaagaagttgatgagggccctagtcctccagagcagtttacggctgtcaaattatctgattccagaatcgccctgaagtctggctatggaaaatatcttggtataaattcagatggacttgttgttgggcgttcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaagagaaaccaagaaaaaagatgacattccagaagaagacaaaggaaatgtaaaacaatgtgaaatcaattatgtaaagaaatttcagagcttccaagaccacaaacttaaaataagtaaagaagacagtaaaattcttaaaaaggctcggaaagatggatttttgcatgagacgcttctggacaggagagccaaattgaaagccgacagatactgcaagtgactgggatttttgtttctgccttatctttctgtgtttttttctgaataaaatattcagaggaaatgcttttacaga

SEQ ID NO: 1761 - DNA, 1797 bp, Homo sapiens
acagccgcccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaatttaaaaaaacagactcccatttcttaaaaacggataagtttgaaaggaaactgctattgaacttaagcatctctagcagagcaatttgatcagtatataaaaccctaggatgtgctaggtctaagatggattaaacaagtataaaataaaatacatttataaaataaaaaggaaaacagacttaaa

SEQ ID NO: 1762 - DNA, 1580 bp, Homo sapiens
tccacgaggctgccggcttaggacccccagctccgacgtaagtccctctcgtgcgccacctccatccgctgcccctctgcccacgggccgggctcaggtgggtaggggtttgaccccttccgctcctctccgccccccatccacgcccacatctctctgcctcctctcctgggctacagtgggccgctctgcctcgctcccgcccgcctgcctcagtctccccagctctctgccacccccctcggaccagtgcctcttaggtctctccagcgcgccatccctgcaaggcggcccctgacaccaactcactttttcctctgagcgcgggaggcgttactcactcttcctccttcccctcctcgccgactcccgggctctgggcccctgggggagggaagaggcctcctatctactcctctgccccagtcccctccttgcgtcagtcccagtgagggataagcgcctggcggaaggcgcagggaggtgtttctctgcttcaggagtgcccgccggcccttgcagctgctggaagacccatttatctcatgcttcttgttttctttggggacctgcaggggaaggaagcagggtgacggtttggtatccccacctaagaccctcccctttcccctgaggccagccgtcagcccctggcagggggtcttggaagccagaggtttttgctcagggcagggaaagggctgcaggatccccgggggctgccggaggtcggtctcactgacatcatggctgaccccagcatcgcctggtcccacagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttg

SEQ ID NO: 1763 - DNA, 632 bp, Homo sapiens
tgcacaccagctgtgtagatgtgggagaggggtttcttccagatgcagactctcagtaatatcccttgtttctgcctccatggctcactcctgccctccactgatctggccactctctcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttgc

SEQ ID NO: 1764 - DNA, 752 bp, Homo sapiens
ctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatggcgcctatatcacagcttatggagtcacacacttcttgatgaacatgttggctgtttccagctttttctgtctacacacagcaccacaatgagcaactttgtcccttcctccttgagcaaacgcacttggaatatgtactgactatgtgctggtcatggttctaaatattttgcgtatgttaactcattcaaccttcacgcaaaccctaagaggcagaaattaccattgtccccattttacagacaaggaaacagaggctgtgagtaactggttcaaggtctcacaacaagtcagggacgcagctggaatcgaagtccaggaatctggcaccagagcctgtgcttttatccaagacaatacagggcaaaggacatgcatgcttaatgttttaaaatttgccctcctgccgcccaggcacagtggctcatgcctgtcatcccagcacttttggaggctgaggcgggtggatcgcttgagcccagg

SEQ ID NO: 1765 - DNA, 872 bp, Homo sapiens
ggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttgccc

SEQ ID NO: 1766 - DNA, 897 bp, Homo sapiens
tgggctacagtgggccgctctgcctcgctcccgcccgcctgcctcagtctccccagctctctgccacccccctcggaccagtgcctcttagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttgcccc

SEQ ID NO: 1767 - DNA, 907 bp, Homo sapiens
tctctccacgaggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttgcccc

SEQ ID NO: 1768 - DNA, 1003 bp, Homo sapiens
acaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtgagaactggggttgggtgggaaggacaccaagaccaggagggggacttatgacggagggctgggttctcaaaggtccctgggcaattttgttttaaatgaggtatctattagctgcatatacatacaaaccaccacagaattcagtggtttaaaataatgaccatttattgagctctcaataccacagtttggaaacataggctgggctcagctgggtgattcttctggtctcaactggatttactcttgcatctgagttcagttgtgggtcagcaggaaactttgtttctggggtgccttggctctttgccacatcatcttatccttcactaagctagcctgggcttgttcgcatggtggtggcagggatctaagatagagtgaatgcatgcaggctcagaactggccattatcacttctgcctcattccata

SEQ ID NO: 1769 - DNA, 2849 bp, Homo sapiens
cctggcgaaagcaagacgtggaggttttaccaggggttagtagcttcctcttgctaactttttattgggacaaaaggcaagatggcaccattctgttctcagatatttgtctaaataaagcccttttaattttattttatttttgttgtgggattcttaagcagataagaagaaaagacaccttcctagtgagcagctgcccagctcctgctcagttttgcctcggggtagcacctccagccacagaaagcaagccggtaagtctctccaggtaggacttgctgcaacccagctgctggactgatctgaaacgggactttgcatactctccgaagtatggtgagttggtgctgacttcaaagttgcctggtgaaggaagataaggtggatcgcagagactaaggggagagggagaagccctgctcctcttctccccaccaaggcacaatgagcaacatctgtcagaggctctgggagtacctagaaccctatctcccctgtttgtccacggaggcagacaagtcaaccgtgattgaaaatccaggggccctttgctctccccagtcacagaggcatggccactactttgtggctttgtttgattaccaggctcggactgctgaggacttgagcttccgagcaggtgacaaacttcaagttctggacactttgcatgagggctggtggtttgccagacacttggagaaaagacgagatggctccagtcagcaactacaaggctatattccttctaactacgtggctgaggacagaagcctacaggcagagccgtggttctttggagcaatcggaagatcagatgcagagaaacaactattatattcagaaaacaagaccggttcctttctaatcagagaaagtgaaagccaaaaaggagaattctctctttcagttttagatggagcagttgtaaaacactacagaattaaaagactggatgaagggggattttttctcacgcgaagaagaatcttttcaacactgaacgaatttgtgagccactacaccaagacaagtgacggcctgtgtgtcaagctggggaaaccatgcttaaagatccaggtcccagctccatttgatttgtcgtataaaaccgtggaccaatgggagatagaccgcaactccatacagcttctgaagcgattgggatctggtcagtttggcgaagtatgggaaggtctgtggaacaataccactccagtagcagtgaaaacattaaaaccaggttcaatggatccaaatgacttcctgagggaggcacagataatgaagaacctaagacatccaaagcttatccagctttatgctgtttgcactttagaagatccaatttatattattacagagttgatgagacatggaagtctgcaagaatatctccaaaatgacactggatcaaaaatccatctgactcaacaggtagacatggcggcacaggttgcctctggaatggcctatctggagtctcggaactacattcacagagatctggctgccagaaatgtcctcgttggtgaacataatatctacaaagtagcagattttggacttgccagagtttttaaggtagataatgaagacatctatgaatctagacacgaaataaagctgccggtgaagtggactgcgcccgaagccattcgtagtaataaattcagcattaagtccgatgtatggtcatttggaatccttctttatgaaatcattacttatggcaaaatgccttacagtggtatgacaggtgcccaggtaatccagatgttggctcaaaactatagacttccgcaaccatccaactgtccacagcaattttacaacatcatgttggagtgctggaatgcagagcctaaggaacgacctacatttgagacactgcgttggaaacttgaagactattttgaaacagactcttcatattcagatgcaaataacttcataagatgaacactggagaagaatatcaaataataaagtagcaaaacaaattcaaataatccattccaaaatacaatgttatcaaccaactgcacaatcagtttatcctgacatattcaagtgataggataaagttggccatgtattatgaaaaagattatttgtgcattttattgactgggcaacactgcaggacagtcaaggtgatatataatttcctcactgcctggtaaaattaagcacactaaaccaagttatttttctttttaagagatacttacatttccatttattgtttgaaatgtcgatcaagagaatcaacagatgatagtccaatttttactcagtgactgttgtagcattttcctgtttactgattagagtggttattcattattcctcagattgctgaatcccatcaggctgttattatgaaggaatttgattgctttgctgcacagcaggacctgtgctttgagatttttttttctcttttaaaatatcctgtaactacaatgatggtaaagccatgttaaatgacttgattgtacttggagtaattgcacatttttttctatgcataaaaaaatgatgcagctgttgagaaaacgaagtctttttcattttgcagaaggaaatgatggaatttttctgtacttcagtatgtgtcaactgagagtcatatacattagttttaatctcttaatattgagaatcaggttgcaaaacggatgagttattatctatggaaatgtgagaaatgtctaatagcccataaagtctgagaaataggtatcaaaatagtttaggaaaatgagaggagaacagtaggattgctgtggcctagacttctgagtaattaataaagaaaaagaagtaccctttggcctaca

SEQ ID NO: 1770 - DNA, 1152 bp, Homo sapiens
aggtcctgactatgctgacactgagacaatgtggtactccagaaccacatggattcaacttcactactacctaatccatggataagagttttagatggagcagttgtaaaacactacagaattaaaagactggatgaagggggattttttctcacgcgaagaagaatcttttcaacactgaacgaatttgtgagccactacaccaagacaagtgacggcctgtgtgtcaagctggggaaaccatgcttaaagatccaggtcccagctccatttgatttgtcgtataaaaccgtggaccaatgggagatagaccgcaactccatacagcttctgaagcgattgggatctggtcagtttggcgaagtatgggaaggtctgtggaacaataccactccagtagcagtgaaaacattaaaaccaggttcaatggatccaaatgacttcctgagggaggcacagataatgaagaacctaagacatccaaagcttatccagctttatgctgtttgcactttagaagatccaatttatattattacagagttgatgagacatggaagtctgcaagaatatctccaaaatgacactggatcaaaaatccatctgactcaacaggtagacatggcggcacaggttgcctctggaatggcctatctggagtctcggaactacattcacagagatctggctgccagaaatgtcctcgttggtgaacataatatctacaaagtagcagattttggacttgccagagtttttaaggtagataatgaagacatctatgaatctagacacgaaataaagctgccggtgaagtggactgcgcccgaagccattcgtagtaataaattcagcattaagtccgatgtatggtcatttggaatccttctttatgaaatcattacttatggcaaaatgccttacagtggtatgacaggtgcccaggtaatccagatgttggctcaaaactatagacttccgcaaccatccaactgtccacagcaattttacaacatcatgttggagtgctggaatgcagagcctaaggaacgacctacatttgagacactgcgttggaaacttgaagactattttgaaacagactcttcatattcagatgcaaataacttcataagatgaacactggagaag

SEQ ID NO: 1771 - DNA, 2813 bp, Homo sapiens
tgcccgacgtgggtggggggggcgtggaatcggagcacaacttggccctgcgttcccaggaagggacccgaagacctccccaggccaccccgccatctgcgtgcgcgctggcaagaggaggggcgcggggtaatggtggccggcgccacagccccgcgccgcgcagggtcttgcccaccaccagcgatgcccagcccttggtagagcttgaaccaccttctataaacaggatggcggtggagagacaggcccagtccctgagcccatgaggagtgtggccccttcaggcccaaagatggggaacatcactgcagacaactcctcgatgagctgtaccatcgaccataccatccaccagacgctggccccggtggtctatgttaccgtgctggtggtgggcttcccggccaactgcctgtccctctacttcggctacctgcagatcaaggcccggaacgagctgggcgtgtacctgtgcaacctgacggtggccgacctcttctacatctgctcgctgcccttctggctgcagtacgtgctgcagcacgacaactggtctcacggcgacctgtcctgccaggtgtgcggcatcctcctgtacgagaacatctacatcagcgtgggcttcctctgctgcatctccgtggaccgctacctggctgtggcccatcccttccgcttccaccagttccggaccctgaaggcggccgtcggcgtcagcgtggtcatctgggccaaggagctgctgaccagcatctacttcctgatgcacgaggaggtcatcgaggacgagaaccagcaccgcgtgtgctttgagcactaccccatccaggcatggcagcgcgccatcaactactaccgcttcctggtgggcttcctcttccccatctgcctgctgctggcgtcctaccagggcatcctgcgcgccgtgcgccggagccacggcacccagaagagccgcaaggaccagatccagcggctggtgctcagcaccgtggtcatcttcctggcctgcttcctgccctaccacgtgttgctgctggtgcgcagcgtctgggaggccagctgcgacttcgccaagggcgttttcaacgcctaccacttctccctcctgctcaccagcttcaactgcgtcgccgaccccgtgctctactgcttcgtcagcgagaccacccaccgggacctggcccgcctccgcggggcctgcctggccttcctcacctgctccaggaccggccgggccagggaggcctacccgctgggtgcccccgaggcctccgggaaaagcggggcccagggtgaggagcccgagctgttgaccaagctccacccggccttccagacccctaactcgccagggtcgggcgggttccccacgggcaggttggcctagcctgggtcctccgcgggtggctccacgtgaggcctgagccttcagcccacgggcctcagggcctgccgcctcctgcttccctcgctgcggaggcagggaagcccctgtaactccggaagcctgctctcgcttgctgagcccgctgggaccgccgagggtgggaataagccccggttggctcgtgggaataagccgtgtcctctgccgcggctgcgatgtggccaggctggggctgctggtcgggggaagacagtgaactgcgttccctggcctgcttcctgcagagtttgtgcatggggagtgtgaggacatggagggtgggaggctgggcgttcagctgccagggccttccaatgccaccgttgtcacagacaatgcctgtccaaacgtcccggtgggatcagcactgcagcccgcccacaacagggtgggaagggaagactggagggggaaggaaggcaggagggggaaggaagaaagagggggaaggaaagaaagaggggggaaggaaaggaggaaggggagaaggaagggaggaggaaagaaggaaggtagggggtgttgggttgggagaattgagggagttataggcagaggaggatcctagctccagccataagaactgggagagccgcctgctgctccagaagacctgcccacctccacagaaatgctagcccttcagaccttctggtcagtgaactgggaccagctctgactaaggatgccttccatggcctgggactcgagttcttcagaaccaagaggctaactgggcttcctccaagaagggaccaggggctagaagcagaagttggcatcagcaaacatttctggaatctaccaaagggaggcccaggcagaaccccttcctcagtctcccttcccctcttccccccagccttgaagaggttgatcctttgtgctgtgtctcttagccctttcatcggggatgcccagaggcaacagcccaggctggaggtgccccagggaagggtgctcacagtggtcccagggctacacttggctttgactgcacagcccctgctcagatccttgtggagggtgtccgatgacttggggaggttctcttccccttcctagaggaggaagtgaccaagtttgaaggcggcagaaatggccacacagccaagaagagcccatgcaactcagtccaggattttactgggtcagtgacattggtggaagccttcatgcctcctcattccacagcacttcctcctatgttgaccttaaacactggcttcccactgatacagactgggatgagctgagggcagtctcatttactgtcaagagttgtatttttgtattgtcctttttgccaagtctacatgtgttgactctgtaatggatttatgtagcccacttcagtctgcaaataaagcaaagtaactgg

SEQ ID NO: 1772 - DNA, 1355 bp, Homo sapiens
gctcctcacctggttgcagagaccacactgccttcctggggccctgaggctctaggagaagctggaaagcacaggtgggggtccatccagctgtttccaaactgcgggttgtgacccattcatgggtcagtaaatcaacttcatagctcatgacctgcatttaaaaaattgaaatagaatagaaatgatcagagtgcgtggcaagaagtaggggtcttgcccaccaccagcgatgcccagcccttggtagagcttgaaccaccttctataaacaggatggcggtggagagacaggcccagtccctgagcccatgaggagtgtggccccttcaggcccaaagatggggaacatcactgcagacaactcctcgatgagctgtaccatcgaccataccatccaccagacgctggccccggtggtctatgttaccgtgctggtggtgggcttcccggccaactgcctgtccctctacttcggctacctgcagatcaaggcccggaacgagctgggcgtgtacctgtgcaacctgacggtggccgacctcttctacatctgctcgctgcccttctggctgcagtacgtgctgcagcacgacaactggtctcacggcgacctgtcctgccaggtgtgcggcatcctcctgtacgagaacatctacatcagcgtgggcttcctctgctgcatctccgtggaccgctacctggctgtggcccatcccttccgcttccaccagttccggaccctgaaggcggccgtcggcgtcagcgtggtcatctgggccaaggagctgctgaccagcatctacttcctgatgcacgaggaggtcatcgaggacgagaaccagcaccgcgtgtgctttgagcactaccccatccaggcatggcagcgcgccatcaactactaccgcttcctggtgggcttcctcttccccatctgcctgctgctggcgtcctaccagggcatcctgcgcgccgtgcgccggagccacggcacccagaagagccgcaaggaccagatccagcggctggtgctcagcaccgtggtcatcttcctggcctgcttcctgccctaccacgtgttgctgctggtgcgcagcgtctgggaggccagctgcgacttcgccaagggcgttttcaacgcctaccacttctccctcctgctcaccagcttcaactgcgtcgccgaccccgtgctctactgcttcgtcagcgagaccacccaccgggacctggcccgcctccgcggggcctgcctggccttcctcacctgctccaggaccggccgggccagggaggcctacccgctgggtgcccccgaggcctccgggaaaagcggggcccagggtgaggagccc

SEQ ID NO: 1773 - DNA, 2859 bp, Homo sapiens
gtcagcgtgaaaggcagggcatggaccctcactcagggctgcgtgtgcccgacgtgggtggggggggcgtggaatcggagcacaacttggccctgcgttcccaggaagggacccgaagacctccccaggccaccccgccatctgcgtgcgcgctggcaagaggaggggcgcggggtaatggtggccggcgccacagccccgcgccgcgcagggtcttgcccaccaccagcgatgcccagcccttggtagagcttgaaccaccttctataaacaggatggcggtggagagacaggcccagtccctgagcccatgaggagtgtggccccttcaggcccaaagatggggaacatcactgcagacaactcctcgatgagctgtaccatcgaccataccatccaccagacgctggccccggtggtctatgttaccgtgctggtggtgggcttcccggccaactgcctgtccctctacttcggctacctgcagatcaaggcccggaacgagctgggcgtgtacctgtgcaacctgacggtggccgacctcttctacatctgctcgctgcccttctggctgcagtacgtgctgcagcacgacaactggtctcacggcgacctgtcctgccaggtgtgcggcatcctcctgtacgagaacatctacatcagcgtgggcttcctctgctgcatctccgtggaccgctacctggctgtggcccatcccttccgcttccaccagttccggaccctgaaggcggccgtcggcgtcagcgtggtcatctgggccaaggagctgctgaccagcatctacttcctgatgcacgaggaggtcatcgaggacgagaaccagcaccgcgtgtgctttgagcactaccccatccaggcatggcagcgcgccatcaactactaccgcttcctggtgggcttcctcttccccatctgcctgctgctggcgtcctaccagggcatcctgcgcgccgtgcgccggagccacggcacccagaagagccgcaaggaccagatccagcggctggtgctcagcaccgtggtcatcttcctggcctgcttcctgccctaccacgtgttgctgctggtgcgcagcgtctgggaggccagctgcgacttcgccaagggcgttttcaacgcctaccacttctccctcctgctcaccagcttcaactgcgtcgccgaccccgtgctctactgcttcgtcagcgagaccacccaccgggacctggcccgcctccgcggggcctgcctggccttcctcacctgctccaggaccggccgggccagggaggcctacccgctgggtgcccccgaggcctccgggaaaagcggggcccagggtgaggagcccgagctgttgaccaagctccacccggccttccagacccctaactcgccagggtcgggcgggttccccacgggcaggttggcctagcctgggtcctccgcgggtggctccacgtgaggcctgagccttcagcccacgggcctcagggcctgccgcctcctgcttccctcgctgcggaggcagggaagcccctgtaactccggaagcctgctctcgcttgctgagcccgctgggaccgccgagggtgggaataagccccggttggctcgtgggaataagccgtgtcctctgccgcggctgcgatgtggccaggctggggctgctggtcgggggaagacagtgaactgcgttccctggcctgcttcctgcagagtttgtgcatggggagtgtgaggacatggagggtgggaggctgggcgttcagctgccagggccttccaatgccaccgttgtcacagacaatgcctgtccaaacgtcccggtgggatcagcactgcagcccgcccacaacagggtgggaagggaagactggagggggaaggaaggcaggagggggaaggaagaaagagggggaaggaaagaaagaggggggaaggaaaggaggaaggggagaaggaagggaggaggaaagaaggaaggtagggggtgttgggttgggagaattgagggagttataggcagaggaggatcctagctccagccataagaactgggagagccgcctgctgctccagaagacctgcccacctccacagaaatgctagcccttcagaccttctggtcagtgaactgggaccagctctgactaaggatgccttccatggcctgggactcgagttcttcagaaccaagaggctaactgggcttcctccaagaagggaccaggggctagaagcagaagttggcatcagcaaacatttctggaatctaccaaagggaggcccaggcagaaccccttcctcagtctcccttcccctcttccccccagccttgaagaggttgatcctttgtgctgtgtctcttagccctttcatcggggatgcccagaggcaacagcccaggctggaggtgccccagggaagggtgctcacagtggtcccagggctacacttggctttgactgcacagcccctgctcagatccttgtggagggtgtccgatgacttggggaggttctcttccccttcctagaggaggaagtgaccaagtttgaaggcggcagaaatggccacacagccaagaagagcccatgcaactcagtccaggattttactgggtcagtgacattggtggaagccttcatgcctcctcattccacagcacttcctcctatgttgaccttaaacactggcttcccactgatacagactgggatgagctgagggcagtctcatttactgtcaagagttgtatttttgtattgtcctttttgccaagtctacatgtgttgactctgtaatggatttatgtagcccacttcagtctgcaaataaagcaaagtaactgga

SEQ ID NO: 1774 - DNA, 2859 bp, Homo sapiens
gctcctcacctggttgcagagaccacactgccttcctggggccctgaggctctaggagaagctggaaagcacaggtgggggtccatccagctgtttccaaactgcgggttgtgacccattcatgggtcagtaaatcaacttcatagctcatgacctgcatttaaaaaattgaaatagaatagaaatgatcagagtgcgtggcaagaagtaggggtcttgcccaccaccagcgatgcccagcccttggtagagcttgaaccaccttctataaacaggatggcggtggagagacaggcccagtccctgagcccatgaggagtgtggccccttcaggcccaaagatggggaacatcactgcagacaactcctcgatgagctgtaccatcgaccataccatccaccagacgctggccccggtggtctatgttaccgtgctggtggtgggcttcccggccaactgcctgtccctctacttcggctacctgcagatcaaggcccggaacgagctgggcgtgtacctgtgcaacctgacggtggccgacctcttctacatctgctcgctgcccttctggctgcagtacgtgctgcagcacgacaactggtctcacggcgacctgtcctgccaggtgtgcggcatcctcctgtacgagaacatctacatcagcgtgggcttcctctgctgcatctccgtggaccgctacctggctgtggcccatcccttccgcttccaccagttccggaccctgaaggcggccgtcggcgtcagcgtggtcatctgggccaaggagctgctgaccagcatctacttcctgatgcacgaggaggtcatcgaggacgagaaccagcaccgcgtgtgctttgagcactaccccatccaggcatggcagcgcgccatcaactactaccgcttcctggtgggcttcctcttccccatctgcctgctgctggcgtcctaccagggcatcctgcgcgccgtgcgccggagccacggcacccagaagagccgcaaggaccagatccagcggctggtgctcagcaccgtggtcatcttcctggcctgcttcctgccctaccacgtgttgctgctggtgcgcagcgtctgggaggccagctgcgacttcgccaagggcgttttcaacgcctaccacttctccctcctgctcaccagcttcaactgcgtcgccgaccccgtgctctactgcttcgtcagcgagaccacccaccgggacctggcccgcctccgcggggcctgcctggccttcctcacctgctccaggaccggccgggccagggaggcctacccgctgggtgcccccgaggcctccgggaaaagcggggcccagggtgaggagcccgagctgttgaccaagctccacccggccttccagacccctaactcgccagggtcgggcgggttccccacgggcaggttggcctagcctgggtcctccgcgggtggctccacgtgaggcctgagccttcagcccacgggcctcagggcctgccgcctcctgcttccctcgctgcggaggcagggaagcccctgtaactccggaagcctgctctcgcttgctgagcccgctgggaccgccgagggtgggaataagccccggttggctcgtgggaataagccgtgtcctctgccgcggctgcgatgtggccaggctggggctgctggtcgggggaagacagtgaactgcgttccctggcctgcttcctgcagagtttgtgcatggggagtgtgaggacatggagggtgggaggctgggcgttcagctgccagggccttccaatgccaccgttgtcacagacaatgcctgtccaaacgtcccggtgggatcagcactgcagcccgcccacaacagggtgggaagggaagactggagggggaaggaaggcaggagggggaaggaagaaagagggggaaggaaagaaagaggggggaaggaaaggaggaaggggagaaggaagggaggaggaaagaaggaaggtagggggtgttgggttgggagaattgagggagttataggcagaggaggatcctagctccagccataagaactgggagagccgcctgctgctccagaagacctgcccacctccacagaaatgctagcccttcagaccttctggtcagtgaactgggaccagctctgactaaggatgccttccatggcctgggactcgagttcttcagaaccaagaggctaactgggcttcctccaagaagggaccaggggctagaagcagaagttggcatcagcaaacatttctggaatctaccaaagggaggcccaggcagaaccccttcctcagtctcccttcccctcttccccccagccttgaagaggttgatcctttgtgctgtgtctcttagccctttcatcggggatgcccagaggcaacagcccaggctggaggtgccccagggaagggtgctcacagtggtcccagggctacacttggctttgactgcacagcccctgctcagatccttgtggagggtgtccgatgacttggggaggttctcttccccttcctagaggaggaagtgaccaagtttgaaggcggcagaaatggccacacagccaagaagagcccatgcaactcagtccaggattttactgggtcagtgacattggtggaagccttcatgcctcctcattccacagcacttcctcctatgttgaccttaaacactggcttcccactgatacagactgggatgagctgagggcagtctcatttactgtcaagagttgtatttttgtattgtcctttttgccaagtctacatgtgttgactctgtaatggatttatgtagcccacttcagtctgcaaataaagcaaagtaactgg

SEQ ID NO: 1775 - DNA, 2528 bp, Homo sapiens
ctgcatcgtctgccgctttggtgacttctgacagctctctccatggaaggaggcggcggccgcgatgagccttcagcctgccgggcaggggacgtgaacatggatgaccctaagaaggaagtgcaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcatggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagc

SEQ ID NO: 1776 - DNA, 3112 bp, Homo sapiens
attcgctgcgctgaagcagtgcgcatgcgcactggacgcttcttaccagcgtcctgactacaatacccaggacgcacccagcccgccgcctctcggagcccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcatggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcata

SEQ ID NO: 1777 - DNA, 3037 bp, Homo sapiens
gcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacata

SEQ ID NO: 1778 - DNA, 1393 bp, Homo sapiens
aaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatcc

SEQ ID NO: 1779 - DNA, 1224 bp, Homo sapiens
ggcctctctgttgtaaattagtggttaaggttatctattattgccacttttccagcgctaaaggctgttttggaaccagtgttgcttgttccgcgggtgattggcttttttttttggcaaaccagttattcaagtttctggtctttaaaaaactctgtggcggtacggtaaccgaggaggttccagcgcggcggaagtaccccgcgggtgggtgtgtgcgcaaggccagggccagaggggcacgtggcgccgggaggagagagaatgtcttttcgaggcggaggtcgtggaggctttaatcgaggtggtggaggtggcggcttcaaccgaggtggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtcttattaggagagttcctgcatccctgtgaagatgacatagtttgtaaatgtaccacagatgaaaataaggtgccttatttcaatgctcctgtttacttagaaaacaaagaacaaattggaaaagtggatgaaatatttggacaactcagagatttttatttttcagttaagttgtcagaaaacatgaaggcttcatcctttaaaaaactacagaagttttatatagacccatataagctgctgccactgcagaggtttttacctcgacctccaggtgagaaaggacctccaagaggtggtggcaggggaggccgaggaggaggaagaggaggaggtggcagaggtggtggcagaggcggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaagcatatttgaatttttaaaataaagtgttttattcccttaa

SEQ ID NO: 1780 - DNA, 1008 bp, Homo sapiens
ccgctgttatacgtcacttccacggctcagcgtcagggaggagagagaatgtcttttcgaggcggaggtcgtggaggctttaatcgaggtggtggaggtggcggcttcaaccgaggtggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtcttattaggagagttcctgcatccctgtgaagatgacatagtttgtaaatgtaccacagatgaaaataaggtgccttatttcaatgctcctgtttacttagaaaacaaagaacaaattggaaaagtggatgaaatatttggacaactcagagatttttatttttcagttaagttgtcagaaaacatgaaggcttcatcctttaaaaaactacagaagttttatatagacccatataagctgctgccactgcagaggtttttacctcgacctccaggtgagaaaggacctccaagaggtggtggcaggggaggccgaggaggaggaagaggaggaggtggcagaggtggtggcagaggcggtggttttagaggtggaagaggaggtggaggtgggggcttcagaggaggaagaggtggtggtttcagagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaagcatatttgaatttttaaaataaagtgttttattcccttaa

SEQ ID NO: 1781 - DNA, 2021 bp, Homo sapiens
aaagggtgagaggggcaggtggggctagggtggagaccaaagcactgatgtgacggaaccatcagccaggcaactggacctggtggatccaggaagactttctggaagaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccc

SEQ ID NO: 1782 - DNA, 2350 bp, Homo sapiens
gggaggaccccaatctaggcccaagagggaaagccacgtgcctgtatgagcgtatgagcatgtgcatgcgcgtgtgtgcacagggtggtgcacctggcaggggtccttgagtgaggcatgccccattctgtagcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctc

SEQ ID NO: 1783 - DNA, 2729 bp, Homo sapiens
ggcttggggctagggcgtgactgtctccctgccaccatcaccgcccgccggccgtgactgcaataagagaagtccgaggcggcttcctcctccctgcccagcaggggcggcggtcagaggcgggcagcaccccagttctccccgcacgccggcactcgcggctgctggagccccggctggctcaccccggggccgggcagaattgggctccaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaaccatgaaatacccttgaaccttcctttgggagcgggggtggtcaatagggggtgaacggacagatatggctacaggcagcagcaggggaagctggagagggccctaatgcctaccaagcacggggcatccaaggtgtggagttttagaacacccagagtcccactgctcatctgcacgtgagtttagaagacaagcagctgaagatacattaaaatgtccccttcgttgctga

SEQ ID NO: 1784 - DNA, 2483 bp, Homo sapiens
ctctgagtgttgcaatggcaatgtttctggcagggtgtgggggacccttgctcaatgacctcctgccctgttgctcagaggataccgctgccagaaaagggttggctcattgtggggcttcccaaggtactctggtagccccagcttctgacctggtcctttctctggtatggggataggaggagagctccggaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaaccatg

SEQ ID NO: 1785 - DNA, 1104 bp, Homo sapiens
ctcattgtggggcttcccaaggtactctggtagccccagcttctgacctggtcctttctctggtatggggataggaggagagctccggaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgct

SEQ ID NO: 1786 - DNA, 2242 bp, Homo sapiens
aataagagaagtccgaggcggcttcctcctccctgcccagcaggggcggcggtcagaggcgggcagcaccccagttctccccgcacgccggcactcgcggctgctggagccccggctggctcaccccggggccgggcagaattgggctccaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaaccatg

SEQ ID NO: 1787 - DNA, 1138 bp, Homo sapiens
ggacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctga

SEQ ID NO: 1788 - DNA, 1497 bp, Homo sapiens
caaaggccaaggccagccaggacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtgaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccaggtgaaccggccactgaccatgcggaaggatggtattcagactcgaaaccgcaaggcatctggaaaagggaaaaagaaacggggctccagtctgggaggcacaggagcagccgaaggaccagctggtggctttatggtggtggctgggggcagcggtagcgggaattgtggggaggtggcttcaggcctgacactgggccccccaggtactgcccatctctaccaaggcctgggccctgtggtgctgtcagggcctgttagccacctcatgcctttccctggacccctactgggctcacccacgggctccttccccacaggccccatgccccccaccaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctg

SEQ ID NO: 1789 - DNA, 463 bp, Homo sapiens
ggcagaacaggcccctcatccggcccaagaagcgcctgattgtcagtaaacgggcaggtactcagtgcaccaactgccagacgaccaccacgacactgtggcggagaaatgccagtggggatcccgtgtgcaatgcctgcggcctctactacaagctacaccaggtgaaccggccactgaccatgcggaaggatggtattcagactcgaaaccgcaaggcatctggaaaagggaaaaagaaacggggctccagtctgggaggcacaggagcagccgaaggaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctgaaa

SEQ ID NO: 1790 - DNA, 2654 bp, Homo sapiens
gagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggcctctgcaaaggaaataccagttctgggcaatcagtgttaccgttcaccagttgccgttgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggc

SEQ ID NO: 1791 - DNA, 3078 bp, Homo sapiens
ctgagctgcctggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacagaaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggcctctgcaaaggaaataccagttctgggcaatcagtgttaccgttcaccagttgccgttgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaaggtggttgtgctcggagggtttcttgtttcttttccattttgtttttggatgatatttattaaatagcttctaagagtccggcggcatctgtcttgtccctattcctgcagcctgtgctgagggtagcagtgtatgagctaccagcgtgcatgtcagcgaccctggcccgacaggccacgtcctgcaatcggcccggctgcctcttcgccctgtcgtgttctgtgttagtgatcactgcctttaatacagtctgttggaataatattataagcataataataaagtgaaaatattttaaaacta

SEQ ID NO: 1792 - DNA, 947 bp, Homo sapiens
ggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagaccctgtctgcaatgcctgtgggctctactacaagcttcacaatgt

SEQ ID NO: 1793 - DNA, 1094 bp, Homo sapiens
atgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaagcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttg

SEQ ID NO: 1794 - DNA, 1420 bp, Homo sapiens
taacgctccctaaactgccacttgctcagctccgcgcctaaggtgtctattagtacgcctgcgctgtgacctagaatgggcgcatgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggatagcaaagatgatgagagggttcctgctttgaatttattaatctgcttggttagcaggtattttgaccaacgtgatttagctgatgagccatcttgatgtagctgatctctcagggatagaagatatttctcatgaaggcagcctaactctgaggaaaacaatgccaattcaagtacagatttcaacacatcttcaacactatgtgaagggttcacatcttaacctgtgcaattcagattgatactcagaatatgggttgatttgaatatctgaaatatcaatggaaaatcccactcagtttttgatgaacagtttgaacagttttctgtaatcaagcagcttgcatagaaattgtatgatgaaattttacataggttcttggtgctgttttgttctttttttgttttttgttgttttgttatttacttatatacatataaaattttattgaaaatatgttttggttactaaaattttgtttgactcctaacaaaagacaatggatggccttagcatcagaattaaaataatctggattaaatggcaatgtgttcatagtcagcaataaaattaaacatttttccctttaa

SEQ ID NO: 1795 - DNA, 801 bp, Homo sapiens
atgcgccgagcggaactggctggtttgaaaaccatggcgtgggtaccagcggagtccgcagtggaagagttgatgcctcggctattgccggtagagccttgcgacttgacggaaggtttcgatccctcggtacccccgaggacgcctcaggaatacctgaggcgggtccagatcgaagcagctcaatgtccagatgttgtggtagctcaaattgacccaaagaagttgaaaaggaagcaaagtgtgaatatttctctttcaggatgccaacccgcccctgaaggttattccccaacacttcaatggcaacagcaacaagtggcacagttttcaactgttcgacagaatgtgaacaaacatagaagtcactggaaatcacaacagttggatagtaatgtgacaatgccaaaatctgaagatgaagaaggctggaagaaattttgtctgggtgaaaagttatgtgctgacggggctgttggaccagccacaaatgaaagtcctggaatagattatgtacaaattggttttcctcccttgcttagtattgttagcagaatgaatcaggcaacagtaactagtgtcttggaatatctgagtaattggtttggagaaagagactttactccagaattgggaagatggctttatgctttattggcttgtcttgaaaagcctttgttacctgaggctcattcactgattcggcagcttgcaagaaggtgctctgaagtgaggctcttagtggtattttgaccaacgtgatttagctgatgagccatcttgatgtagctgatctctcag

SEQ ID NO: 1796 - DNA, 3613 bp, Homo sapiens
gcacaccccccagcccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatcag

SEQ ID NO: 1797 - DNA, 1725 bp, Homo sapiens
ctcagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaa

SEQ ID NO: 1798 - DNA, 480 bp, Homo sapiens
ggttaagtttaagaggctggagggatggctagctggaggtctgcgttgtagagaggtaaccccagtgtccccacaccctcctctgagacgccatgttcaactcgatgaccccaccaccaatcagtagctatggcgagccctgctgtctccggcccctccccagtcagggggcccccagtgtggggacagaaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatga

SEQ ID NO: 1799 - DNA, 3196 bp, Homo sapiens
atgttcaactcgatgaccccaccaccaatcagtagctatggcgagccctgctgtctccggcccctccccagtcagggggcccccagtgtggggacagaagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcct

SEQ ID NO: 1800 - DNA, 784 bp, Homo sapiens
accgcacaccccccagcccagactccagccctggaccgcgcatcccgagcccagcgcccagacagaggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgca

SEQ ID NO: 1801 - DNA, 3394 bp, Homo sapiens
accgcacaccccccagcccagactccagccctggaccgcgcatcccgagcccagcgcccagacagaggcccactcttttcttctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatc

SEQ ID NO: 1802 - DNA, 187 bp, Homo sapiens
ccagcgcccagacagaggactgtctggcccgcccttctgccaccaagctaacctcatgtccggcccccacagttatgggccagccagagagaccaacagctgcaccgagggcccactcttttcttctccccggagtgcagtcaagttgaccaagaagcgggcactgtccatctcacctctgtcggat

SEQ ID NO: 1803 - DNA, 3475 bp, Homo sapiens
cccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacagaagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcaccatgagcccatctctgggattcccagcccagatgaatcaccaaaaagggccctcgccttcctttggggtccagccttgtggtccccatgactctgcccggggtgggatgatcccacatcctcagtcccggggacccttcccaacttgccagctgaagtctgagctggacatgctggttggcaagtgccgggaggaacccttggaaggtgatatgtccagccccaactccacaggcatacaggatcccctgttggggatgctggatgggcgggaggacctcgagagagaggagaagcgtgagcctgaatctgtgtatgaaactgactgccgttgggatggctgcagccaggaatttgactcccaagagcagctggtgcaccacatcaacagcgagcacatccacggggagcggaaggagttcgtgtgccactgggggggctgctccagggagctgaggcccttcaaagcccagtacatgctggtggttcacatgcgcagacacactggcgagaagccacacaagtgcacgtttgaagggtgccggaagtcatactcacgcctcgaaaacctgaagacgcacctgcggtcacacacgggtgagaagccatacatgtgtgagcacgagggctgcagtaaagccttcagcaatgccagtgaccgagccaagcaccagaatcggacccattccaatgagaagccgtatgtatgtaagctccctggctgcaccaaacgctatacagatcctagctcgctgcgaaaacatgtcaagacagtgcatggtcctgacgcccatgtgaccaaacggcaccgtggggatggccccctgcctcgggcaccatccatttctacagtggagcccaagagggagcgggaaggaggtcccatcagggaggaaagcagactgactgtgccagagggtgccatgaagccacagccaagccctggggcccagtcatcctgcagcagtgaccactccccggcagggagtgcagccaatacagacagtggtgtggaaatgactggcaatgcagggggcagcactgaagacctctccagcttggacgagggaccttgcattgctggcactggtctgtccactcttcgccgccttgagaacctcaggctggaccagctacatcaactccggccaatagggacccggggtctcaaactgcccagcttgtcccacaccggtaccactgtgtcccgccgcgtgggccccccagtctctcttgaacgccgcagcagcagctccagcagcatcagctctgcctatactgtcagccgccgctcctccctggcctctcctttcccccctggctccccaccagagaatggagcatcctccctgcctggccttatgcctgcccagcactacctgcttcgggcaagatatgcttcagccagagggggtggtacttcgcccactgcagcatccagcctggatcggataggtggtcttcccatgcctccttggagaagccgagccgagtatccaggatacaaccccaatgcaggggtcacccggagggccagtgacccagcccaggctgctgaccgtcctgctccagctagagtccagaggttcaagagcctgggctgtgtccataccccacccactgtggcagggggaggacagaactttgatccttacctcccaacctctgtctactcaccacagccccccagcatcactgagaatgctgccatggatgctagagggctacaggaagagccagaagttgggacctccatggtgggcagtggtctgaacccctatatggacttcccacctactgatactctgggatatgggggacctgaaggggcagcagctgagccttatggagcgaggggtccaggctctctgcctcttgggcctggtccacccaccaactatggccccaacccctgtccccagcaggcctcatatcctgaccccacccaagaaacatggggtgagttcccttcccactctgggctgtacccaggccccaaggctctaggtggaacctacagccagtgtcctcgacttgaacattatggacaagtgcaagtcaagccagaacaggggtgcccagtggggtctgactccacaggactggcaccctgcctcaatgcccaccccagtgaggggcccccacatccacagcctctcttttcccattacccccagccctctcctccccaatatctccagtcaggcccctatacccagccaccccctgattatcttccttcagaacccaggccttgcctggactttgattcccccacccattccacagggcagctcaaggctcagcttgtgtgtaattatgttcaatctcaacaggagctactgtgggagggtgggggcagggaagatgcccccgcccaggaaccttcctaccagagtcccaagtttctggggggttcccaggttagcccaagccgtgctaaagctccagtgaacacatatggacctggctttggacccaacttgcccaatcacaagtcaggttcctatcccaccccttcaccatgccatgaaaattttgtagtgggggcaaatagggcttcacatagggcagcagcaccacctcgacttctgcccccattgcccacttgctatgggcctctcaaagtgggaggcacaaaccccagctgtggtcatcctgaggtgggcaggctaggagggggtcctgccttgtaccctcctcccgaaggacaggtatgtaaccccctggactctcttgatcttgacaacactcagctggactttgtggctattctggatgagccccaggggctgagtcctcctccttcccatgatcagcggggcagctctggacataccccacctccctctgggccccccaacatggctgtgggcaacatgagtgtcttactgagatccctacctggggaaacagaattcctcaactctagtgcctaaagagtagggaatctcatccatcacagatcgcatttcctaaggggtttctatccttccagaaaaattgggggagctgcagtcccatgcacaagatgccccagggatgggaggtatgggctgggggctatgtatagtctgtatacgttttgaggagaaatttgataatgacactgtttcctgataataaaggaactgcatc

SEQ ID NO: 1804 - DNA, 1966 bp, Homo sapiens
aaacggtcgtacacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtgg

SEQ ID NO: 1805 - DNA, 1799 bp, Homo sapiens
cgagaactcgggaagccggcgagaagtgtgaggccgcggtagggccgcatcccgctccggagagaagtctgagtccgccaggctctgcaggcccgcggaagctcgacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccggggacctggaagacaagggggatcaggaagtgagtcttgcagcttgtcactaggaagccttgtttggggtccccatgcccttgaaccaggtgaacagggcggggagctaaggcgagctctggcctcttccgtccccagggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctga

SEQ ID NO: 1806 - DNA, 2631 bp, Homo sapiens
agggacagcccagaggaggcgtggccacgctgccggcggaagtggagccctccgcgagcgcgcgaggccgccggggcaggcggggaaaccggacagtaggggcggggcctggccggcgatggggattcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagcc

SEQ ID NO: 1807 - DNA, 1661 bp, Homo sapiens
cgagaactcgggaagccggcgagaagtgtgaggccgcggtagggccgcatcccgctccggagagaagtctgagtccgccaggctctgcaggcccgcggaagctcgacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctga

SEQ ID NO: 1808 - DNA, 817 bp, Homo sapiens
acttcggggctgcgagcgcggagggcgacgacgacgaagcgcagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatgaatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatcc

SEQ ID NO: 1809 - DNA, 1636 bp, Homo sapiens
aaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctga

SEQ ID NO: 1810 - DNA, 1478 bp, Homo sapiens
tcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatgctccttcggaggacgtgccctcacccctcactggtccactggcttgagactcaccccgtctgcccagtaaaagcctttctgcagc

SEQ ID NO: 1811 - DNA, 965 bp, Homo sapiens
tgggaaagagggaaaggcttccccggccagctgcgcggcgactccggggactccagggcgcccctctgcggccgacgcccggggtgcagcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctactatgag

SEQ ID NO: 1812 - DNA, 5801 bp, Homo sapiens
ttttttttttttgggtggcggggggttgcaagtgggaagcctgctgttcagctgccggggctctccgcctccccccacctgtatgaggctgggtctggggaacctgtgctcagcattccaccccctggagcttgggcttggtcttccctgcgggtccctgcgctgacattcaggcggggagccaggaggcctggcgcgcctccagagcccgccgggggagccgggcgagggttctgggctctgacggcggggtcgcagggtcgcccgcctcctggacacgtctgtaggcctagggaagcctgccggccgggaggtacagagtaggagaagccagatcccagggcggacaacgagaagtcgtcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcatgtttctggagaaattaagcttatagacagcatgtgttattaaaaagagttacctattgaaatgatagtgtttctggagatttctcagccccatcttcctccagcttgtctaccttcctcatgcaaacaatattccacatttttatatctagagcatgactggctaactggagagggaaggaaaagtttagatctggttactggagcaagtctcaaagagaaactctgaaagcttccagaatcacaggtataagataaggatagcattgacatttgctgggagttacagtgatagtttcatctcagcagttcatttttttcttcagtcactgctggttttctttgactattatagttgccaggaagatccttgctcttcttactttaaaaccagcatttaagtggcaatttggatgtaataggatgagaccaaatttatctaattattacagtagtaatacatttaagagttaaaaatgtgtttttatatatccacatatgataacaaaagattcaattcccaagcctaaattttgaagcatgtggtattgtcaaatctagcttaccatcttttttgggggtacttgcaaccatagtaaaggaagatggaatagactttagttaactttaattataattatatgttaaataaggcacataaccagtttccaaggtcatcatggttgcttaaagtctttccccttctgtactccatggaaatattctcagtaaaccaaaaacaaaaatggaaaaataatcaccaacccccatcccgacacacacacagagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtttttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttattcaagtggattctgagcctgtatgtcacaatgtaaacactggaggttcactcacctacgcactcacccaccacctctgaaagaaacagaaactgcagagaaagacagcatcttagctcattttgtttttaaatgaggttttagacgcttgccacttcctaagggaaatcctaaaacagagcaagtgatgctcccaggtatcactgtgaacttttttctttcaaagtgtgaatttttacactggctttttcatttttttaaagtaattgaagcttgtggctttacaacttagtgttttttgctatccagataacaagtttcattgtttagaacccagtgacacttaataggtagataaattgtcctttaaaatatcccagatgatatacacaatatggtacatttgtgctctctctctctgtttttctctctttctctttctagttagatcaagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgcttttactttaaatctgctaatttctaaaatgtagagtccttcaccaatcccagagactcaatttggaaatgaactgatttcaagccgttactgtgaataaagcaccccagcattttgtataagctcttaattaaacctgtacagcttctttacctgatttaagaaagggagacaagcaataggggggaataagcttcttcaaaattcattccaagcacaaaagaaattttttccctttgcatataaacttgacatcagttgattctgttggggtcggggtgggtatgcagggattgccttttattatcaagtgatttatttcaagagcctttgaggggattcaggtgaaggaacccccatctgtgctggagagttggatactcctttaaatagcccccaccacagtcataacaataatgataatgctggattatttgttaagccaaggttgtctgcctcatatccatcatgctgtttgcaatattcttgctttcaatcaatttatactgagtgtaactttaggatttctgctattaaatgcatgctctctatcctgcttcagtttctggctttgctttgtctgtttcaaaatatgtagcttcctcttttgtacaacaaaaaactcattctcacttttactaaatatactgtaggagtcatcattgatgttatttttctcttatgtatctgtaaagatttttggcatatgaatgtaatattaaagtcaatgatgctataacttgcgatgtttgcatcatgtcaacctttttgaaggagtgaaaaagccctactatgtttttaaatagcaagtgtaagctcagtgctagagtggatatacacaccgcatgttttcatatgtggcacttttatgtatcatgttgggttattgttctagactggactgttaaatactatgtttgaggctgggttgtcatttttataactgtcttggtgttttatggccattatttattacttttgatacacagaatgagctgcatgcatttatagagcaataagaggatgtatttaatgtgccttgtttttaactgaataagaactggaagcatgaatcaataaaactgattaaaatggtctatttgcta

SEQ ID NO: 1813 - DNA, 1939 bp, Homo sapiens
cagggcggacaacgagaagtcgtcaggctaagaaatggcatttcaaaaggcagtgaaagggacgattcttgttggaggaggtgctcttgcaactgttttaggactttctcagtttgctcattacagaaggaaacaagacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtg

SEQ ID NO: 1814 - DNA, 2397 bp, Homo sapiens
agtcacaacactcatatcctagggaccaccacactgctatgagtcaggcatgtgcgttgtttaaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaa

SEQ ID NO: 1815 - DNA, 2640 bp, Homo sapiens
agtcacaacactcatatcctagggaccaccacactgctatgagtcaggcatgtgcgttgtttaaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattatgagatttaaaatcattttgatgatttctctaagattatgttgagtttctaaaacttggtttgtgttaaatctgttcattgatttggagactgacagatataaaagatgtaaaacttttttacatgttcatagccttctatgaagagtgtggaagaatcacaacaatgaagagaagatatgtttcttggggagcatgttcaatctaattcaagtagatacatggagtcgtgaagataaattctgatcacaccgcattctggtcatcattacctagttgaagaggtttattggagaagaactatcagtgttttaaagcagtggtcttcaaacgggggcacacaaagactttccaaggggggtacataaatataaatagttttaaggt

SEQ ID NO: 1816 - DNA, 456 bp, Homo sapiens
attagtacagcacccagaggtcttcggagcaaagctgttaaagaagtggggtccatttgagccccaactttgccttccttaggtccccttgggcttgtctagccctaggagttccaacaagctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagca

SEQ ID NO: 1817 - DNA, 2457 bp, Homo sapiens
cccgcgcgcctcgctgggagcacccgggccgaggctctgattctggggggaggccgactccaccctggctggaggaactgggtgctcctgcccgctggcccctcgcgcgtgaggatctatctcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaa

SEQ ID NO: 1818 - DNA, 1961 bp, Homo sapiens
ggcccctcgcgcgtgaggatctatctcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcgtgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcatgtttctggagaaattaagcttatagacagcatgtgttattaaaaagagttacctattg

SEQ ID NO: 1819 - DNA, 7711 bp, Homo sapiens
cgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcgaggagccgctgcctggggtctgaagggagctgcctccgccaccgccatggccgctggatccagccgccgcctgcagctgctcctggcgcaatgaggagaggagccgccgccaccgccaccgcccgcctctgactgactcgcgactccgccgccctctagttcgccgggcccctgccgtcagcccgccggatcccgcggcttgccggagctgcagcgtttcccgtcgcatctccgagccaccccctccctccctctccctccctcctacccatccccctttctcttcaagcgtgagactcgtgatccttccgccgcttcccttcttcattgactcggaaaaaaaatccccgaggaaaatataatattcgaagtactcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaaatcctgttcattttagtgttcaatttttttattattattgttgttcttatttaaccttgtaaaatatctataaatacaaaccaatttcattgtattctcactttgagggagatccagggggtgggaggggttgtggggagggggaaagcggagcactagaacatacaatctctctcccacgacaatctttttttattaaaagtctgctgttgtatactttaaaaacaggactcctgcctcatgccccttccacaaaagaagaaaacctttttctgtgctgatgggtttttttgaactttgttttcttttaaagtctagtgtgagactttggtatagtgcacagcttgaaattggttgggagcttagcaggtataactcaacggggacttaaatgtcacttgtaaaattaatccatatcttcgggtatttatagacttgcctttggcatgttggtggcaggtgtggcagacaaagaaatgtgtatcattcgtaacccagggaggtcaataaagtttggaactctacagggaagattcttagtagatttgttaaggttttgttttgctctcagttagtgctagtgatgtagaggcttgtacaggaggctgccagaggggaagcagcaagcaagactcaggcacacatgctctacaggtggctctttgtttgcctgaccaaagttctttgcaaatcttagcacagtttcaaactagtgacctgggaggagatggaaggggtgttgagcaggctgagctagctgctgaggtcaaaggctgatgagcccagaggaaggggacaggtcagggatacatctcaccactgtgaataagtttgtccagatttttttctaaagttacttcccttggaaagatacacttgagaggacattgtagttaaataatgtgaactgtaacagtcatctactggtttatttttcatattttttaattgaaaattgagcttgcagaaatagccacattctacacatagttctaattttaaatccaaatctagaatctgtatttaatttgttttttaacctcatgctttttacatttatttattgatgcatgtcagatggtagaaatattaaaaactacacatcagaatgatacagtcacttatacctgctgactttataggaaagctgatgatataaatgtgtgtatatatgttatatatacatatattcaatactgcctttttttttgtctacagtatcaaaattgactggttgaagcatgagaagaatgtttcccccacacccagttaagagtttttgtgtctgttttctttgtgtatcagtgaacgatgttaagaatcagtctctctttttgaagaaaaagcaatattccttggaaagcaaggagaattgaaggactatgtttgccgtgaggaaatagattttcatgactagtttgttttatacttttaaggttggcatctatgtgggccttatatactctaaaatgaactttagtcaccttggtgcttatgggccattacttgacctatgaatctttaaggcacaatcagttgtactttacatttaaagatcacttgagtgatggccgcctttccctcctacccgctccttccccacatgccttccaaggttagctggtaactgtagggctgcagagctgagcccatggttgtgtgtaacttgccctcaccctcctcattgccaccttaggtcactttatgggtctcgtcctccagagggttcggaagtggagtctgttggcagccctcctgcaggccctagcaccctgtcctgctccttaactgtgtgtgtgactctccaagagagttgtcctgcctgctgaagtgaaccagtacccagaaagacaactgtgagccatcttggttttcactcgctgtttagctgaggtcttgggccacaaaaggggtttcacaaacctctggatatatcagagtttatgagaaaggaaacatgctcagtcaaaccaaatcaaacaaattgaattttatgttttataaagtgcttctgaaagctaagatttgaaagaagtctgaaatcaaagtatttggcagcataactccttaaaggtagtggcgttgatagaccattttcagacagaatttataaagaatctgaaaaggcaggtctgtgatagagaaatggacctgcattcagatccaactgcccagcaagcgtttggatgcagacactgctctggacgtggtatactccccagagtccataaaaatcagtgcttattttaggaaacaggttgccccccacaactggggtaaaagaagagagaaaagtcacgcttttctctcatttcattgtgtgtgcatgtgtgcgtgtgtgtgtgtgtgtgtgtgtgctgagatgtgtgatttttctttctcaaggatcatggtgggatcacagaactcttttatacaagtgagatccaggtctctgaatatctttttgtatataataataataaaaagctcctcaccaaattcaagcttgtacattatattttctttctgtgtttttaaatttaagttttattgttttgtatgtaaatatgtggacccaggaactgttattaatgagcaaaaagttactgttcagggcagtgattctgtttaataatcagacaaaatgtagacgagctttttaaagccatatagttttaactctgtacagtaggtaccggcctgtattattgtaacaataactctagcaatgtatagtgtatctatatagtttggagtgccttcgcttccatgtgtttttttttttaatttgttcttttttaaattttaattggtttcctttatccatgtctccctgtccaccccctttccctttgaaataataactcactcataacagtatctttgccccttccacagttaagtttcagtgataccatactcaggagtgggaagaggaaatcatattcgtaatttcatttcgttgaagccctgcctttgttttggttctgaatgtctttcctcctcggtagcagtgagaccggtttcatttcatacttagtccattcagggacttagtgtagcaccagggagccctagagctggaggatatcgaatagattaaattttgctcgtctcttccacaagccctaaccatgggtcttaaaaacagcagattctgggagccttccatgctctctctctctcctcttttatctacttccctcccaaatgagagagtgacagagaattgtttttttataaatcgaagtttcttaatagtatcaggttttgatacgtcagtggtctaaaatgctatagtgcaattactagcagttactgcacggagtgccaccgtgccaatagaggactgttgttttaacaagggaactcttagcccatttcctccctcccgccatctctacccttgctcaatgaaatatcattttaatttcttttaaaaaaaatcagtttaattcttactgtgtgcccaacacgaaggccttttttgaaagaaaaatagaatgttttgcctcaaagtagtccatataaaatgtcttgaatagaagaaaaaactaccaaaccaaaggttactatttttgaaacatcgtgtgttcattccagcaaggcagaagactgcaccttctttccagtgacatgctgtgtcattttttttaagtcctcttaatttttagacacatttttggtttatgttttaacaatgtatgcctaaccagtcatcttgtctgcaccaatgcaaaggtttctgagaggagtattctctatccctgtggatatgaagacactggcatttcatctatttttccctttcctttttaaaggatttaactttggaatcttccaaaggaagtttggccaatgccagatccccaggaatttggggggttttctttcttttcaactgaaattgtatctgattcctactgttcatgttagtgatcatctaatcacagagccaaacacttttctcccctgtgtggaaaagtaggtatgctttacaataaaatctgtcttttctggtagaaacctgagccactgaaaataaaagagacaactagaagcacagtagagtcccagactgagatctacctttgagaggctttgaaagtaatccctggggtttggattattttcacaagggttatgccgttttattcaagtttgttgctccgttttgcacctctgcaataaaagcaaaatgacaaccagtacataaggggttagcttgacaaagtagacttccttgtgttaatttttaagtttttttttccttaactatatctgtctacaggcagatacagatagttgtatgaaaatctgcttgcctgtaaaatttgcatttataaatgtgttgccgatggatcacttgggcctgtacacataccaattagcgtgaccacttccatcttaaaaacaaacctaaaaaacaaaatttattatatatatatatatatatatataaaggactgtgggttgtatacaaactattgcaaacacttgtgcaaatctgtcttgatataaaggaaaagcaaaatctgtataacattattactacttgaatgcctctgtgactgatttttttttcattttaaatataaacttttttgtgaaaagtatgctcaatgttttttttccctttccccattcccttgtaaatacattttgttctatgtgacttggtttggaaatagttaactggtactgtaatttgcattaaataaaaagtaggttagcctggaaatgaaattaaaattcacaagtgtgtggtctttatttcagtacccaaccctcttccttcaccctactattttgccgctgcaatatgtagtcacatcaccatttccattcctctaattagggaaacattaatctttgttatacagaacaagatatcaataccacttcttgttctttccaatgattttattccattgtgtagccccaagaggtgcagcttccaccttggaaacctttggatttgatgtagaggaagctttgcagacactgcttagaaaagaaagaaaacaactctgaaagggacagtttttaaatgtgtataagctgctgtctttgattactgtgttcatgatttggtgtggctgtattttcttttaactttcatcctattagtaatggtctttgggggtctctgtaaaatatatggacaccacgaacagtggggctgtacctcccaggtaaccaacacatgttgtgtttgagtctgctcatttccaatactggatgatgtatgtaaacatgttatgtctcttagtgcaaaaagaaacatcatttttttagggctggctcactctgtcaggcctaatctaaaggctagatataaggtcatgtgactgctgcttcaataaaaacaaatttatattc

SEQ ID NO: 1820 - DNA, 1636 bp, Homo sapiens
atcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggattcgtcaggaacaggacatttcacctcaggagtgcgggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagaactgtcaagtaatccacctctggctaccatccttattcctcctcatgctcggattcaagcagctgcttcaacccccacaaatgccacagcagcgtcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaaa

SEQ ID NO: 1821 - DNA, 1607 bp, Homo sapiens
actcattttcaatcaagtatttgcccccgtttcacgtgatacatatttttttaggatttgccctctcttttctctcctcccaggaaagggaggggaaagaattgtattttttcccaagtcctaaatcatctatatgttaaatatccgtgccgatctgtcttgaaggagaaatatatcgcttgttttgttttttatagtatacaaaaggagtgaaaagccaagaggacgaagtctttttctttttcttctgtgggagaacttaatgctgcatttatcgttaacctaacaccccaacataaagacaaaaggaagaaaaggaggaaggaaggaaaaggtgattcgcgaagagagtgatcatgtcagggcggcccagaaccacctcctttgcggagagctgcaagccggtgcagcagccttcagcttttggcagcatgaaagttagcagagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaagaatcgagagctccagatcatgagaaagctagatcactgtaacatagtccgattgcgttatttcttctactccagtggtgagaagaaagatgaggtctatcttaatctggtgctggactatgttccggaaacagtatacagagttgccagacactatagtcgagccaaacagacgctccctgtgatttatgtcaagttgtatatgtatcagctgttccgaagtttagcctatatccattcctttggaatctgccatcgggatattaaaccgcagaacctcttgttggatcctgatactgctgtattaaaactctgtgactttggaagtgcaaagcagctggtccgaggagaacccaatgtttcgtatatctgttctcggtactatagggcaccagagttgatctttggagccactgattatacctctagtatagatgtatggtctgctggctgtgtgttggctgagctgttactaggacaaccaatatttccaggggatagtggtgtggatcagttggtagaaataatcaaggtcctgggaactccaacaagggagcaaatcagagaaatgaacccaaactacacagaatttaaattccctcaaattaaggcacatccttggactaaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagacacacctgcactcttcaacttcaccactcaagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatatt

SEQ ID NO: 1822 - DNA, 2854 bp, Homo sapiens
gagaagcaggacctcgggccatggattctactgaagaaaggtagccatggaagagaatatggaagagggacagacacaaaaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatgttttgaaaagaaaatagctttttatactttttagttttgatttcggtaactagtttaactacaggtaaccttcaaagggaccattgtacattatgaacaatagatagagattacatcttgatgactcttgaaatatggaaattttgtctgaagatcagtggccatattactgtaggccctggttcatgttttcatcaatctaaggtgcaatttctaaatttgtaagagtaggtttaaaaaaaaaagtgcttcttatctttgttaacattgtacttttccttgatgttcttaaaaggtatttccctcagattactcatgtttatgttgtgagcatgtagaaacagtaatgctaatgcatggctagttgcctttttaagattgtgacaccaggcttaccttttaaagtttagtatatagagacaattttaatggaaataactactgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggattgcacctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttaaccgaatgttcattcatattcatttataaaaagtacctgtatcaaaggaattttaacaaagagcaatcagtattattggaccaaatttggtgtttgttttcaccttgacgctcttcttttcattatttctaatgctacaagaatgctgtaaagtgtcttctaaaatgatgtagcctgacaagacatttttttcagtgtataaaactaggtagtattgtgcactgatttgaccattgtgaaatcctttctcagtgtaactgcatttctaataaaaatttattgagtgaaacaatctttgtacaatgactagtcatgcatcatcagtaattttacaagttcttgtagtaggtagggggtactactagggatatctgtggcatgattatgcattccgtagtattatttaattaatttggggttcattttgcttccttttctttatgcttagattatcttactggttcaacatttttctgatatatgcagtattacagatattcagcaaaagtattaatgggcttctttaaattctatattatagtatttcagttccgtgtcttaacagtttgtgataatttctaaaactgtcttttcaacttatgtaatgatgttgacacttttggcttttatttctggtattagagtttgtattttcacagagtgctttgtagcaggcattacaattaatctgttttgtacataaatgtgccaacagcttgatggtggcgtttttgaaatgtagaacagagtgcttgcaaaatgtaataaatacacttgtgtactttgtgtacttattattagct

SEQ ID NO: 1823 - DNA, 2821 bp, Homo sapiens
actctggaatgaaggggggaattacgggttggtggtcggcttcatgttaggaggacacccctccatctgttcacagctcagcctgtttccaatttaaagcccagatttcaatacaaacctcaatttcttttccccattttaaatgcaaagcaagacttgtgaatcatagtgtctctgctcctgggattcagaccaaatttccccccaaaattctcaggctatttgtttgaatacctgcttacagtggtacacaatgggcagctttgagaagaaaaattgataatcttcacggaagagtaatttgaatgaaattacacttgacagcctgtctccaagcaaacaagaggaacgagggagcctgagctaagctctgaggacttgcccaagccactgctgttggagcttcccaggaaaaaaaaaaaaaaaaaaaaaaaaaaaaaaaaaaaaaaacccccagtttttccaacatctaattgagcttttgattaattccgtgtaccagattctactgaagaaaggtagccatggaagagaatatggaagagggacagacacaaaaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatgttttgaaaagaaaatagctttttatactttttagttttgatttcggtaactagtttaactacaggtaaccttcaaagggaccattgtacattatgaacaatagatagagattacatcttgatgactcttgaaatatggaaattttgtctgaagatcagtggccatattactgtaggccctggttcatgttttcatcaatctaaggtgcaatttctaaatttgtaagagtaggtttaaaaaaaaaagtgcttcttatctttgttaacattgtacttttccttgatgttcttaaaaggtatttccctcagattactcatgtttatgttgtgagcatgtagaaacagtaatgctaatgcatggctagttgcctttttaagattgtgacaccaggcttaccttttaaagtttagtatatagagacaattttaatggaaataactactgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggattgcacctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttaaccgaatgttcattcatattcatttataaaaagtacctgtatcaaaggaattttaacaaagagcaatcagtattattggaccaaatttggtgtttgttttcaccttgacgctcttcttttcattatttctaatgctacaagaatgctgtaaagtgtcttctaaaatgatgtagcctgacaagacatttttttcagtgtataaaactaggtagtattgtgcactgatttgaccattgtgaaatcctttctcagtgtaactgcatttctaataaaaatttattgagtgaaacaa

SEQ ID NO: 1824 - DNA, 555 bp, Homo sapiens
agttgggattgagattggaaaagagcacaattaaaactagaggactctcatgggaacaagtagtcctcttgggtgtatgcatgtgtacgtgaatctgattggaggtggaagaatggcatgtaggagagaaaaaccagtgttctgaggcagcaggtgttctgtaagacagaccaggaagaggtagtaaggcagccagaaagctaccatggtacaccagagaagccaaattattcttgaggtacccactgagcttgtcagctgcaatggctaagagcttctcaaggaataactactgtcctgaaattagaatgacttttttctgtatgtttctgttttaattacttattctggttaatgcctcctaacaaagatcatcaggaaatctgtatttgaataagttcggtacatttcgatgatggagaatgcacatcataagaaagcgtggagcacctcagtaagagggtgttagaaaggatttattacagatttggacttgcattagattctactgaagaaaggtagccatggaagagaatatggaagagggacagacac

SEQ ID NO: 1825 - DNA, 2614 bp, Homo sapiens
gggtgctgagacaacgtgtgtgtctgtaatgtgcattcaatgtatttaggagagagactttgcacgtgtctctaatgaaagtgaaagggggcagggtgggggcctctggggaggagacccacagtgaaggggaggaaaacgggcttctcgcagaggaggcaggtggaaagagggaggggtctgtgcgcccgcagagtcgccaggcgccctgcgagttgtctccgctgggaggggcgaggctgtcacttgccagggcgcgaggagcctcagcgcggcttggagaacttggccccgcgcagcgtctggtcactcgctctcctctggggactgcagagaagcaggacctcgggccatggggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatgttttgaaaagaaaatagctttttatactttttagttttgatttcggtaactagtttaactacaggtaaccttcaaagggaccattgtacattatgaacaatagatagagattacatcttgatgactcttgaaatatggaaattttgtctgaagatcagtggccatattactgtaggccctggttcatgttttcatcaatctaaggtgcaatttctaaatttgtaagagtaggtttaaaaaaaaaagtgcttcttatctttgttaacattgtacttttccttgatgttcttaaaaggtatttccctcagattactcatgtttatgttgtgagcatgtagaaacagtaatgctaatgcatggctagttgcctttttaagattgtgacaccaggcttaccttttaaagtttagtatatagagacaattttaatggaaataactactgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggattgcacctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttaaccgaatgttcattcatattcatttataaaaagtacctgtatcaaaggaattttaacaaagagcaatcagtattattggaccaaatttggtgtttgttttcaccttgacgctcttcttttcattatttctaatgctacaagaatgctgtaaagtgtcttctaaaatgatgtagcctgacaagacatttttttcagtgtataaaactaggtagtattgtgcactgatttgaccattgtgaaatcctttctcagtgtaactgcatttctaataaaaatttattgagtgaaac

SEQ ID NO: 1826 - DNA, 734 bp, Homo sapiens
agcaggtgttctgtaagacagaccaggaagaggtagtaaggcagccagaaagctaccatggtacaccagagaagccaaattattcttgaggtacccactgagcttgtcagctgcaatggctaagagtggctgataatgttccttacttctgtagctgagatttcccaacttaatttgggttctcatcagggtagaattccatccaagtcaatcgcagcatctgcacccacagctctgagaagggaaagatgtgcttggtggtggccccaagtttgcagtatcggattggactcattagaattacaaggaaatgaaataaagaaagattctactgaagaaaggtagccatggaagagaatatggaagagggacagacacaaaaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttgg

SEQ ID NO: 1827 - DNA, 1500 bp, Homo sapiens
gcatatattaaatttgtctgactaggaagagttatgtcagtaaagcaattagatacatgggttgtgatttggggaaaaaagctgaattagaaatctgtacttgtaaatcatcaacaagtatgtaatcattggtgatgttgatactgatgaaatcaacctaaaggtggaacaaaaaggaccaaaaatagtgacttaaaaaaacaatttagaaaaaatctcagaacacgaaacagaatgttaaattgtcacaggagagagcttatgcccttgaatcaagggaaaatagagttcacaaggagccagcggccggcagcatcacacttttatgacagacctggaagggtgttttgaatgctgtatcaaatgcctggggggcattccctatgcctctctgattgccaccatcctgctctatgcgggtgttgccctgttctgtggctgcggtcatgaagcgctttctggaactgtcaacattctgcaaacctactttgagatggcaagaactgctggagacacactggatgtttttaccatgattgacatctttaagtatgtgatctacggcatcgcagctgcgttctttgtgtatggcattttgctgatggtggaaggtttcttcacaactggggccatcaaagatctctatggggatttcaaaatcaccacttgtggcagatgtgtgagcgcttggttcattatgctgacatatcttttcatgttggcctggctgggagtcacggctttcacctcactgccagtttacatgtacttcaatctgtggaccatctgccggaacaccacattagtggagggagcaaatctctgcttggaccttcgtcagtttggaattgtgacaattggagaggaaaagaaaatttgtactgtctctgagaatttcttgaggatgtgcgaatctactgagctgaacatgaccttccacttgtttattgtggcacttgctggagctggggcagcagtcattgctatggttcactaccttatggttctgtctgccaactgggcctatgtgaaagacgcctgccggatgcagaagtatgaagacatcaagtcgaaggaagagcaagagcttcatgacatccactctactcgctccaaagagcggctcaatgcatacacataaatgcatcttcctgttctttctaccatttgaatgcattggtgtttaactaagggccatccaaccatccaacctttaaaaaacaaaacgaaagtgcttctcatcaatgatatgtaaggtgacttatgaatcacctgagtacaattctttgttgtttagcacttaaatttcccaatttattaaattgatgtaaatcagatcttttctacaagctcctatccagccttttttttgaaatttctcaaactcatttactagttctgtaaaatcaaagatactaacattgtcaaatgcaaagatttgtttgatttttaaccacttcccatgtgttatacataacaccttttgcattatttcttatg

SEQ ID NO: 1828 - DNA, 3022 bp, Homo sapiens
atcttcactttttccgttgctagcagtggaagggtcacagaccaaacactaaggcctgagcggtgacaaccgaggcgagatgatggtcaacagggaatgcctcgtgggagaaaaaagacaattttattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaactt

SEQ ID NO: 1829 - DNA, 3046 bp, Homo sapiens
ggagacgcggcggcgctggacgcggaggcgctgggcgcacggcgcggagccggccggagctcgaggccggcggcggcgggagagcgacccgggcggcctcgtagcggggccccggatccccgagtggcggccggagcctcgaaaagagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaagaccagttaaagaccctgcagaggaattacggcaggctgcagcaggatgtcctccagtttcagaagaaccagaccaacctggagaggaagttctcctacgacctgagccagtgcatcaatcagatgaaggaggtgaaggaacagtgtgaggagcgaatagaagaggtcaccaaaaaggggaatgaagctgtagcttccagagacctgagtgaaaacaacgaccagagacagcagctccaagccctcagtgagcctcagcccaggctgcaggcagcaggcctgccacacacagaggtgccacaagggaagggaaacgtgcttggtaacagcaagtcccagacaccagcccccagttccgaagtggttttggattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagcaagcagccctggcagggaatgacagaaacatagatgtttttaatgttgaagatcagaaaagagacaccataaatttacttgatcagcgtgaaaagcggaatcatacactctgaattgaactggaatcacatatttcacaacagggccgaagagatgactataaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagccacctatagaagagtccatctgctgtgaaggagagacagagaactctgggttccgtcgtcctgtccacgtgctgtaccaagtgctggtgccagcctgttacctgttctcactgaaaagtctggctaatgctcttgtgtagtcacttctgattctgacaatcaatcaatcaatggcctagagcactgactgttaacacaaacgtcactagcaaagtagcaacagctttaagtctaaatacaaagctgttctgtgtgagaattttttaaaaggctacttgtataataacccttgtcatttttaatgtacaaaacgctattaagtggcttagaatttgaacatttgtggtctttatttactttgcttcgtgtgtgggcaaagcaacatcttccctaaatatatattaccaagaaaagcaagaagcagattaggtttttgacaaaacaaacaggccaaaagggggctgacctggagcagagcatggtgagaggcaaggcatgagagggcaagtttgttgtggacagatctgtgcctactttattactggagtaaaagaaaacaaagttcattgatgtcgaaggatatatacagtgttagaaattaggactgtttagaaaaacaggaatacaatggttgtttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaagtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcaattcacgttgccacctccaacttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaactta

SEQ ID NO: 1830 - DNA, 506 bp, Homo sapiens
atcttcactttttccgttgctagcagtggaagggtcacagaccaaacactaaggcctgagcggtgacaaccgaggcgagatgatggtcaacagggaatgcctcgtgggagaaaaaagacaattttagtctcactctgttgcccccaggctggagtgcagtggcgcgatctcgactcactgcaacctctgcctcccgggttcaagtgattcttctgcctcagcctcccgagtagctaggactacagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcag

SEQ ID NO: 1831 - DNA, 869 bp, Homo sapiens
acagatacggtccctaaagtgagaaatgaatgttcgaaagaaggtgctctcgtttggcatggagtgaatgccttgtttccacctcaaatcctaagatggaacacatttttcctggtgacttcaggcagatggcacacctcccacttccgttgtgtgtcatgaaggaggagacacttctatagccagggctgtgcctgaataatgatgtacatgggggggagttcacattcacctccagaatgggtttcctgctttgcttgagaaatgctttaattgggtgtcattagtaatcctgtcaagggtaaaaaaaacctcccttgttaggaatcaaagcaaaaagctctctctgaggagtaatgaggaatatactctttctaatatgatgcggaagcacttaatatttgttattggtgtttacagaaatgattacttctcaaacattgctgcttacagaaatgattaattctcaaactatgccgggaagattctcagcgctgattttgagatgatgggcttgggaaacgggcgtcgcagcatgaagtcgccgcccctcgtgctggccgccctggtggcctgcatcatcgtcttgggcttcaactactggattgcgagctcccggagcgtggacctccagacacggatcatggagctggaaggcagggtccgcagggcggctgcagagagaggcgccgtggagctgaagaagaacgagttccagggagagctggagaagcagcgggagcagcttgacaaaatccagtccagccacaacttccagctggagagcgtcaacaagctgtaccaggacgaaaaggcggttttggtgaataacatcaccacaggtgagaggctcatccgagtgctgcaag

SEQ ID NO: 1832 - DNA, 1760 bp, Homo sapiens
gtcctatatttgttgtatagcctcctttgtggaagttatgtatgcatttgacttcacttaatctaagacatctattttccttgaactcttgataggtctgctggtttcctcaagggaatccaatctagctggattttaatctctttgaattgtgtcctcagctataaaagttttagctgaggttttaatggctgcacttaagtaaatctaacagatataccagggggtgttccaattacatacaccattaaagggctttatgtgaggatttttaaaaattaccattaaaaaaaaaaaagcatagtccatttgcagtataatttaccagcaggaaagatttcaatgtcctggaaaaattccctataaaaaggaagataggaaaacagaaaagtcacagtactcaacctacttcaagggaagattgggatctttttggctctctgcctctaaacaggtaaaaggctttgtattatttctagcacgagtttttcttctttagattgcatgctattgtatgtctacagggcatttgacagcccaagggctaaatccaggtgtgacggtatctaatgatgtcctgtccttcactgtccttgccatcaccagccacagagatccaggctttggggactcccacagcttatcgaccagtgtttgatttagtttttagcctctttcccatcaaatgaaaattaacttggagacacatttcattagaaaattagaggcccccttggctaggaaggcatctggtctgggactaactactttgaacagtgttgagtcctctctcccacagatggttcagccagcagtaatgctaggaagactgaaggataaatagaaaaatgtcattagtaccatggggtagccatgtaatgtcaagcaattttatattagccagagattcctagtaggagctacttttcttaacagatgactcagttctctttatctcaggaatgaaagagttgaagaccaatccacaacaggggaaatgttaaggcaaaatgatgaacttgataagggatgaattatggggtttggataaccaaacaataaaaataaaagtatagactattttagtactaaaaaggtcctgaacatgtgagcttaagtactcattttgtccccagtggctaagaaactaaaggcaagccagcaagtgtctctgagtttcagtgtctgtatgtaaaaactgactctgacttccatcttctgcagggttagtgatacagatgctagctttttcactaaagaggtcttttagtttatactcaaccttgtctggatctaatttgattgtgcattcatgtgccttagaatgaagccaattcaaaaactcctagctggccttattctactgacttggtgcgtggaaggctgctccagccagcactggtcctatggactgcgccctggaggaaagagagatgccgaaaatttgattgattctttccaagagatagtcaaagaggttggtcaactggcagaaacccaacgcttcgaatgcaccacgcaccagccacgttctcccctccgagacctgaaaggagctctggaaagtctgattgaagaggaaactgggcagaagaagatttaaatccattgggccagaaggaatgaccattactaacatgacttaagtataattctgacattgaaaatttataacccattaaatacctgtaaatggtatgaatttcagaaatccttacaccaagttgcacatattccataataaagtgctgtgttgtgaa

SEQ ID NO: 1833 - DNA, 470 bp, Homo sapiens
gggatctttttggctctctgcctctaaacagaatgaagccaattcaaaaactcctagctggccttattctactgacttggtgcgtggaaggctgctccagccagcactggtcctatggactgcgccctggaggaaagagagatgccgaaaatttgattgattctttccaagagatagtcaaagaggttggtcaactggcagaaacccaacgcttcgaatgcaccacgcaccagccacgttctcccctccgagacctgaaaggagctctggaaagtctgattgaagaggaaactgggcagaagaagatttaaatccattgggccagaaggaatgaccattactaacatgacttaagtataattctgacattgaaaatttataacccattaaatacctgtaaatggtatgaatttcagaaatccttacaccaagttgcacatattccataataaagtgctgtgttgtgaatg

SEQ ID NO: 1834 - DNA, 1259 bp, Homo sapiens
cccgcgggttgagttcagcgaacgctgcggctaggggagggcgggaggagggagagcggacgcagggggcggggaggggcgcagggctgcgcgctcgccggcgctctctttcggtttggtcggcggctggaggagagtggacccccccactttaaggctctgtcctcggcgcgttcccgccgccccccggtcccgacgcggggctcggggatgcccgccagcatgttcagcatcgacaacatcctagccgcccggccgcgctgcaaggactcggtgttgccggtggcgcacagcgcggcggctcccgtcgtcttcccggccctgcacggggactcgctctacggcgccagcggcggcgcctcctcggactatggcgccttctacccgcgccccgtggcccccggcggcgcgggcctcccggccgcggtcagcggctcccgcctcggctacaacaactacttctacgggcagctgcacgtgcaggcggcgcccgtgggcccggcctgctgcggggccgtgccgccgctgggcgcccagcagtgctcctgcgtcccgacgcccccaggctacgagggccccggttcggtgctggtgtccccggtaccgcaccagatgctgccctacatgaacgtgggcacgctgtcgcgcaccgagctgcagcttctcaaccagctgcactgtcggcggaagcggcggcaccgcaccatcttcactgacgagcagctcgaagctctcgagaacctcttccaggagaccaagtacccggacgtgggcacgcgcgagcagctggcccggaaagtgcacctccgcgaggagaaagtggaggtctggtttaagaaccgccgcgccaaatggaggcggcagaagcggtcctcatcagaggagtcggagaacgcggagaagtggaacaagacgtcgtcgtcgaaggcgtcaccggagaagagggaagaggaaggtaaaagcgatttggactcggacagctgacggccgcgggacacttgcccgtattacttacctaactcgaaggacttgcacagacagacgatgctactttcttgcacacgcgctgccttgcgggagggggtcgagaaagaggaacgaggagctgtaaatagtgtacagagccgggagggtcggcgtctggggtcagggcgcgcacagcccagcagcccgaggccgcccgcgactagcccccaccgtagtatttatagttaaattaagggtgacagtacaataaagtgatggcgatgtagacgggc

SEQ ID NO: 1835 - DNA, 1992 bp, Homo sapiens
ggcctgcggaagggggcgggttcggaggagtgaactgtgcggttagtgcgcctttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactctaattgttcagaaattttacatttgacttatttgacaacattaacattagtggtggctttgccattaaaaacccagtaagtattttgagtgcatctatgtgatgtggtgttttgagcatagtaggcaccacagcaacttttctgcgtggtactaaaactgccgaaaatgcgacgtagaatcaccagatctttagtgtttaatatccctggtataagatgttataattaatgtaatttctttcttggcaaacacctcatgtctgtcttagtgaagatttaataaaccacttatttttcttat

SEQ ID NO: 1836 - DNA, 846 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagattttagccgcagctgcttcttctttggtggatttgaggggtgggtgtcagtggcatgctggggtgagctgtgtagtccttcaataaatgtctgtcgtgtgtcccata

SEQ ID NO: 1837 - DNA, 858 bp, Homo sapiens
cctgggccctcctgctccttgcagccatgctcctgggcaacccagcccctgcctccgcatctgcgtggtgaaggccattggccctcatcggtggatctgcgtttcctcgggcctacactgtctaggattgtgcggggctggtgagagaacaagatctcttctgtgttcaaggcagacttcctgccccctgcaccctgctctctcccaggccttgaggtcagtgtgagccccaagggcaagaacacttctggaagggagagtggatttggctgggccatctggatggaaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaagattttagccgc

SEQ ID NO: 1838 - DNA, 4168 bp, Homo sapiens
atttaaacgggagacggcgcgatgcctggcactcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtg

SEQ ID NO: 1839 - DNA, 3026 bp, Homo sapiens
atgagccgcacagcctacacggtgggagccctgcttctcctcttggggaccctgctgccggctgctgaagggaaaaagaaagggtcccaaggtgccatccccccgccagacaaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcatt

SEQ ID NO: 1840 - DNA, 2648 bp, Homo sapiens
actcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagag

SEQ ID NO: 1841 - DNA, 803 bp, Homo sapiens
agtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaagcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgc

SEQ ID NO: 1842 - DNA, 1496 bp, Homo sapiens
ctgactccaggagctggggtcaaattgctggagcaggctgatttgcatagcccaatggccaagctgcatgcaaatgaggcggaaggtggttggctgagggttggcaggataaccccggagagcggggccctttgtcctccagtggctggtaggcagtggctgggaggcagcggcccaattagtgtcgtgcggcccgtggcgaggcgaggtccggggagcgagcgagcaagcaaggcgggaggggtggccggagctgcggcggctggcacaggaggaggagcccgggcgggcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcagaagaccgaaaggatggataaggtgggggatgccctggaggaagtgctcagcaaagccctgagtcagcgcacgatcactgtcggggtgtacgaagcggccaagctgctcaacgtcgaccccgataacgtggtgttgtgcctgctggcggcggacgaggacgacgacagagatgtggctctgcagatccacttcaccctgatccaggcgttttgctgcgagaacgacatcaacatcctgcgcgtcagcaacccgggccggctggcggagctcctgctcttggagaccgacgctggccccgcggcgagcgagggcgccgagcagcccccggacctgcactgcgtgctggtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacctttgtagttactcaagcagttactccctacactgatgcaaggattacagaaactgatgccaaggggctgagtgagttcaactacatgttctgggggcccggagatagatgactttgcagatggaaagaggtgaaaatgaagaaggaagctgtgttgaaacagaaaaataagtcaaaaggaacaaaaattacaaagaaccatgcaggaaggaaaactatgtattaatttagaatggttgagttacattaaaataaaccaaatatgttaaagtttaagtgtgcagccatagtttgggtatttttggtttatatgccctcaagtaaaagaaaagccgaaagggttaatcatatttgaaaaccatattttattgtattttgatgagatattaaattctcaaagttttattataaattctactaagttattttatgacatgaaaagttatttatgctataaattttttgaaacacaatacctacaataaactggtatgaataattgcatcatttc

SEQ ID NO: 1843 - DNA, 1375 bp, Homo sapiens
tcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctctg

SEQ ID NO: 1844 - DNA, 1065 bp, Homo sapiens
cactcgctggtggtgggcgcgccgtgctgagctctggctgtcagtgtgttcgcccgcgtcccctccgcgctctccgcttgtggataactagctgctggttgatcgcactatgactctggaagaagtccgcggccaggacacagttccggaaagcacagccaggatgcagggtgccgggaaagcgctgcatgagttgctgctgtcggcgcagcgtcagggctgcctcactgccggcgtctacgagtcagccaaagtcttgaacgtggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcgaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcccgaggaggggcccggtggcggcagggccaggctggtccgagctgaggactctgcaagtgtctggagcggctgctcgcccaggaaggcctaggctaggacgttggcctcagggccaggaaggacagactggccgggcaggcgtgactcagcagcctgcgctcggcaggaaggagcggcgccctggacttggtacagttgcaggagcgtgaaggacttagccgactgcgctgctttttcaaaacggatccgggcaatgcttcgttttctaaaggatgctgctgttgaagctttgaattttacaataaactttttgaaacaaa

SEQ ID NO: 1845 - DNA, 977 bp, Homo sapiens
gctgagctctggctgtcagtgtgttcgcccgcgtcccctccgcgctctccgcttgtggataactagctgctggttgatcgcactatgactctggaagaagtccgcggccaggacacagttccggaaagcacagccaggtgggtttcagggcgctgagaaagccgctggtcggtcggcgaccgtcagggttttccagggtgggaatccgcggggtaggaggggagcgcgggggtccgggcgccagatcccggttggagagccggggtgcaggcgctgagccgggattggagtgtggttggagttggggagccaagggtgtgtgccggtggccggggctggggtctccgccgcgccctccggccggctcccgctcactgcgctggctcctccgcaggatgcagggtgccgggaaagcgctgcatgagttgctgctgtcggcgcagcgtcagggctgcctcactgccggcgtctacgagtcagccaaagtcttgaacgtggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcgaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcc

SEQ ID NO: 1846 - DNA, 2218 bp, Homo sapiens
caggcggcggcggcagcggcggcggttggtcaggggcgtgttggccccgcacagattgagccgagttgtcgccccgctgggagaagtgaccctcctgcgcctgaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgcccatgcaagaagatctgtcaatctggttatctggtttattaggtattaaagttaaggcagaaaaattattggaagaacttgataatggagtactattatgtcaactgattgatgttcttcaaaacatggtgaaaacatgcaactctgaagaatcagggaattttccaatgagaaaagtgccctgtaagaaagatgctgcatcaggttcattctttgctcgggacaataccgcaaacttccttcactggtgtagggacattggggttgatgaaacttacctctttgaatctgaaggtttagttttgcacaaagatccaagacaggtgtatctttgtcttcttgaaattggtcgaattgtgtcaagatacggggttgagccaccagtgttagtaaaacttgagaaagaaattgagttagaagagactttgcttaatacttctgggcctgaagattccatcagcattccaaaatcatgctgtcggcatgaagagctacatgaagctgttaaacatattgctgaggaccctccttgtagttgttctcatcgattttctattgagtatttatctgaaggacggtaccgactaggggataaaatactctttataagaatgcttcatggaaaacatgtcatggttcgcgttggtggaggctgggatactcttcaaggatttttgcttaaatatgacccctgtcgaatattacagtttgccacattagaacaaaaaattttagcatttcaaaaaggagtttctaatgaaagtgtacctgattcgcctgccagaacacctcagcctcctgaaatgaatcctttgtcagcagttaacatgtttcagaaacaaaattcaaaacccagcgtgccagttagtattccaaaaagcaaagaaaaacagggacgtccaccaggtgcattggtgccagcatcttcactgaaaggaggtaatctgggctctatgtcagtccgttctaaattgccaaattctccagcagcatcttctcatcccaagctcaagtcttcaaaaggcataacgaagaaaccgcaggctccttcaaacaatgcatcatcttcacttgcttcattaaatccagtaggtaaaaacacttcttcaccagctttaccaagaactgcaccttgtatatctgagtcaccgagaaaatgtatttcatcccccaatacccccaaggccaaggttattccagcccagaattcagcagatctgcccgagtccacacttttgccaaataagtgttcaggaaaaactcaacctaagtatttgaaacataatcatatttcttccagagataatgcagtatctcacttagctgcacattcaaattcatcctcaaaatgtcccaagctgcctaaagcaaatatacctgtaagacctaaaccttctttccagtcctctgcaaaaatgacaaaaaccagttccaaaaccatagccacgggtctaggaacacagtctcaaccatccgatggagccccacaagcaaagccagtcccagcacagaaacttaaatcggccttgaatttaaatcagccagtttctgtgtcctcagtttctcctgtaaaagccacacagaaatcaaaagataagaatatagtttcagctaccaaaaagcagcctcagaataaaagtgcatttcagaagacaggacccagctccttgaagtctcctggccgtaccccactgtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataa

SEQ ID NO: 1847 - DNA, 2486 bp, Homo sapiens
atgtggaactccattttaataggagcagcttctttgctgcatttttaaaaaatggtcttggaagcttcttacttccgagaagtggatctttgttgcggacaaaggattatttatgctaaaggaaaatgtattccccactgaattagctcgtgggaagcataacaagctcattaggaatgctcacttgtactttggccttttgctgtggtggagagaagggaaaatgacatcaaaaaggacattctgttgtcttttgccttcctgcaaagaaaatgtgttataatattaggcttttcagtatggtttagctcaggttcaactttggtactagaagaaatgttcctgaaaggaaagtgaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgcccatgcaagaagatctgtcaatctggttatctggtttattaggtattaaagttaaggcagaaaaattattggaagaacttgataatggagtactattatgtcaactgattgatgttcttcaaaacatggtgaaaacatgcaactctgaagaatcagggaattttccaatgagaaaagtgccctgtaagaaagatgctgcatcaggttcattctttgctcgggacaataccgcaaacttccttcactggtgtagggacattggggttgatgaaacttacctctttgaatctgaaggtttagttttgcacaaagatccaagacaggtgtatctttgtcttcttgaaattggtcgaattgtgtcaagatacggggttgagccaccagtgttagtaaaacttgagaaagaaattgagttagaagagactttgcttaatacttctgggcctgaagattccatcagcattccaaaatcatgctgtcggcatgaagagctacatgaagctgttaaacatattgctgaggaccctccttgtagttgttctcatcgattttctattgagtatttatctgaaggacggtaccgactaggggataaaatactctttataagaatgcttcatggaaaacatgtcatggttcgcgttggtggaggctgggatactcttcaaggatttttgcttaaatatgacccctgtcgaatattacagtttgccacattagaacaaaaaattttagcatttcaaaaaggagtttctaatgaaagtgtacctgattcgcctgccagaacacctcagcctcctgaaatgaatcctttgtcagcagttaacatgtttcagaaacaaaattcaaaacccagcgtgccagttagtattccaaaaagcaaagaaaaacagggacgtccaccaggtgcattggtgccagcatcttcactgaaaggaggtaatctgggctctatgtcagtccgttctaaattgccaaattctccagcagcatcttctcatcccaagctcaagtcttcaaaaggcataacgaagaaaccgcaggctccttcaaacaatgcatcatcttcacttgcttcattaaatccagtaggtaaaaacacttcttcaccagctttaccaagaactgcaccttgtatatctgagtcaccgagaaaatgtatttcatcccccaatacccccaaggccaaggttattccagcccagaattcagcagatctgcccgagtccacacttttgccaaataagtgttcaggaaaaactcaacctaagtatttgaaacataatcatatttcttccagagataatgcagtatctcacttagctgcacattcaaattcatcctcaaaatgtcccaagctgcctaaagcaaatatacctgtaagacctaaaccttctttccagtcctctgcaaaaatgacaaaaaccagttccaaaaccatagccacgggtctaggaacacagtctcaaccatccgatggagccccacaagcaaagccagtcccagcacagaaacttaaatcggccttgaatttaaatcagccagtttctgtgtcctcagtttctcctgtaaaagccacacagaaatcaaaagataagaatatagtttcagctaccaaaaagcagcctcagaataaaagtgcatttcagaagacaggacccagctccttgaagtctcctggccgtaccccactgtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataaatacatactcattat

SEQ ID NO: 1848 - DNA, 2340 bp, Homo sapiens
gtcaggggcgtgttggccccgcacagattgagccgagttgtcgccccgctgggagaagtgaccctcctgcgcctgatcagaacactgaggctcagagaagttaactactccaaagtcatatagccagtattttctggagctgtaattcaaatcagatgtgttcaataccttctactaccccattgctgtctttatgaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgcccatgcaagaagatctgtcaatctggttatctggtttattaggtattaaagttaaggcagaaaaattattggaagaacttgataatggagtactattatgtcaactgattgatgttcttcaaaacatggtgaaaacatgcaactctgaagaatcagggaattttccaatgagaaaagtgccctgtaagaaagatgctgcatcaggttcattctttgctcgggacaataccgcaaacttccttcactggtgtagggacattggggttgatgaaacttacctctttgaatctgaaggtttagttttgcacaaagatccaagacaggtgtatctttgtcttcttgaaattggtcgaattgtgtcaagatacggggttgagccaccagtgttagtaaaacttgagaaagaaattgagttagaagagactttgcttaatacttctgggcctgaagattccatcagcattccaaaatcatgctgtcggcatgaagagctacatgaagctgttaaacatattgctgaggaccctccttgtagttgttctcatcgattttctattgagtatttatctgaaggacggtaccgactaggggataaaatactctttataagaatgcttcatggaaaacatgtcatggttcgcgttggtggaggctgggatactcttcaaggatttttgcttaaatatgacccctgtcgaatattacagtttgccacattagaacaaaaaattttagcatttcaaaaaggagtttctaatgaaagtgtacctgattcgcctgccagaacacctcagcctcctgaaatgaatcctttgtcagcagttaacatgtttcagaaacaaaattcaaaacccagcgtgccagttagtattccaaaaagcaaagaaaaacagggacgtccaccaggtgcattggtgccagcatcttcactgaaaggaggtaatctgggctctatgtcagtccgttctaaattgccaaattctccagcagcatcttctcatcccaagctcaagtcttcaaaaggcataacgaagaaaccgcaggctccttcaaacaatgcatcatcttcacttgcttcattaaatccagtaggtaaaaacacttcttcaccagctttaccaagaactgcaccttgtatatctgagtcaccgagaaaatgtatttcatcccccaatacccccaaggccaaggttattccagcccagaattcagcagatctgcccgagtccacacttttgccaaataagtgttcaggaaaaactcaacctaagtatttgaaacataatcatatttcttccagagataatgcagtatctcacttagctgcacattcaaattcatcctcaaaatgtcccaagctgcctaaagcaaatatacctgtaagacctaaaccttctttccagtcctctgcaaaaatgacaaaaaccagttccaaaaccatagccacgggtctaggaacacagtctcaaccatccgatggagccccacaagcaaagccagtcccagcacagaaacttaaatcggccttgaatttaaatcagccagtttctgtgtcctcagtttctcctgtaaaagccacacagaaatcaaaagataagaatatagtttcagctaccaaaaagcagcctcagaataaaagtgcatttcagaagacaggacccagctccttgaagtctcctggccgtaccccactgtccatcgtgagcctaccccagtcttctaccaaaacacaaactgcaccgaagtcagcacagactgtcgctaagagccagcattcaactaaagggcctcccagaagtggcaaaaccccagcttcaatcaggaaaccaccctcatctgttaaggatgcagatagtggagataaaaaacctactgcaaagaaaaaggaagatgatgaccattattttgtcatgactggaagtaagaaacctagaaaataaatacatactcattataaaaaaagagaaaa

SEQ ID NO: 1849 - DNA, 567 bp, Homo sapiens
ctcttttcctggcgaacttttacgcgctgtctcggggcctccgcgcctcagcctgagggctccaggagccccccgctctctgaggccccgaagctgaggtttgttgggtctcccggctgcgggagccagtacgctctgcgtttgcctggctgcggcagtcgcgtgctctgattggctcctggggccgtcaagatcagaacactgaggctcagagaagttaactactccaaagtcatatagccagtattttctggagctgtaattcaaatcagatgtgttcaataccttctactaccccattgctgtctttatgatttgtaacagatggagccatgacattttgaattctccccatcataccgtataacgtgagaaaggattgaaaatgtaaaagaaatttcatttcaatataggtgactatgcagcctgcaattcaagtatggtttggagaagatctgcctctaagtcctcggagtcctctgactcccagacacggaccaggattggctaatgtttgtcagtacgatgagtggatagctgtgaggcatgaagccactttgttgccca

SEQ ID NO: 1850 - DNA, 5032 bp, Homo sapiens
ggggaggtcgggaggaggcagagagggaagcgagctgcggccgggcgggctcggcgctcggagacccggtggagcccaaagtttccgcgcagcccctgggtggcggcagcgccggcggcgcggggcgcccgggacagtcttgagcgccggcctcgccccgcggggacccgcgcccgccgccggccacgccgagtgtcgcccgcagccacgcggaggcggcggggagccgcgcgcggcagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttc

SEQ ID NO: 1851 - DNA, 2050 bp, Homo sapiens
aaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgttta

SEQ ID NO: 1852 - DNA, 2627 bp, Homo sapiens
cagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagacttgggaggctgcattctgataattctcaggaggaagaatgtataggagagaccagggtttttaaggtgtgacctctgaaccacctacatcagagctgactgcctctcgctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggtgctgcagcgcagtaaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgttta

SEQ ID NO: 1853 - DNA, 4785 bp, Homo sapiens
cgcaactttgcctcccagggaacaaacatcctccttctaagtggtagatgtgggtgagctgaccctgctggagtctgtcccctgggctaccctctgcttccccccattgtgagtggtccgtgaagcacagcgttgaccagacctaaacctgtttgctcccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttc

SEQ ID NO: 1854 - DNA, 4705 bp, Homo sapiens
aaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttc

SEQ ID NO: 1855 - DNA, 2627 bp, Homo sapiens; identical to SEQ ID NO: 1852

SEQ ID NO: 1856 - DNA, 2289 bp, Homo sapiens
gaagcgagctgcggccgggcgggctcggcgctcggagacccggtggagcccaaagtttccgcgcagcccctgggtggcggcagcgccggcggcgcggggcgcccgggacagtcttgagcgccggcctcgccccgcggggacccgcgcccgccgccggccacgccgagtgtcgcccgcagccacgcggaggcggcggggagccgcgcgcggcaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaa

SEQ ID NO: 1857 - DNA, 4760 bp, Homo sapiens
accgactctgtgaattgggtaccttcatgatacccattttataaatgagaaaactgaggtttttactatatgctggtcatcatgctgaggactttacttggattttctctcctgccaatgctacgcggtggggaccttcatgttctcccctttgcagatgagattatcaaagcagaaaaagaccatctctcctactgagtaacagaggaaaccagggcttgcagatattgaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 1858 - DNA, 5432 bp, Homo sapiens
ggcagccgggcgccccgcggggctctccgcgctgcgttcccgacccctggggggaggtgtggagtccaagcggtgcattcttgaaccatcttgtcagacgccggcggctcgcgggctgtggcgggggctgcggtcaaggccgcgctcctgggggccgccgcctgggagggtgggcgcccaggcgtccctgcagccccgggtgctccgactgcgcggcggggccgcggcgcgcgcgcccgggcgtccgggcgtccgggacagtggtgccagacactcccaaatcccgagccggcccagcctcgtacggaggaccttttttttggttctgttggtgacccgttagccgccgctggggcctaacaccaagttgagggctcgcggattagccgcccgccagccgtggaaatgtgataagagcggtaccgtttgcagaaggaaatttctgatgcaactcttcgcctttgctgattgcctctccaaacgcctgcctgacgactgccttggagcatgtgcgttatggaaattaggctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggttctgaaaatattgtgcacagggcaggctgaggacacagccacgtgatacccactgtagagagagggagagagagacctcctatgcaagctgccggccctctgttccgtagtaaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttca

SEQ ID NO: 1859 - DNA, 2700 bp, Homo sapiens
ctttccagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacagatattctggaggaaggtgtgaacgcaactttgcctcccagggaacaaacatcctccttctaagtggtagatgtgggtgagctgaccctgctggagtctgtcccctgggctaccctctgcttccccccattgtgagtggtccgtgaagcacagcgttgaccagacctaaacctgtttgctcccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttccca

SEQ ID NO: 1860 - DNA, 2279 bp, Homo sapiens
cagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgttta

SEQ ID NO: 1861 - DNA, 733 bp, Homo sapiens
cgagctgcggccgggcgggctcggcgctcggagacccggtggagcccaaagtttccgcgcagcccctgggtggcggcagcgccggcggcgcggggcgcccgggacagtcttgagcgccggcctcgccccgcggggacccgcgcccgccgccggccacgccgagtgtcgcccgcagccacgcggaggcggcggggagccgcgcgcggcaggtgctgcagcgcagtaaatgtaatttgaagaaggcagaaggaacccatggctttagccggctgcccagattcctttttgcaccatccgtactaccaggttctgaaaatattgtgcacagggcaggctgaggacacagccacgtgatacccactgtagagagagggagagagagacctcctatgcaagctgccggccctctgttccgtagtaaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcag

SEQ ID NO: 1862 - DNA, 4656 bp, Homo sapiens
atgcaagctgccggccctctgttccgtagtaaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcatcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatgtcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttc

SEQ ID NO: 1863 - DNA, 3181 bp, Homo sapiens
aagttctcgcgggacaccgacggggagcggaagccaggaggtattgctgcttcggcgaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacgggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 1864 - DNA, 3248 bp, Homo sapiens
gaccgggcggcggcagcggcggcggcggctgtggcagagtctgtgcctgtggcggtgacggcggcgggagcaagcgctgccctcgcagagcagccttggggtcgccggccgctcgcagcgttgtggaggggcgggccggacgctgagcggagcagctgcgccacgggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 1865 - DNA, 3729 bp, Homo sapiens
gagtacgggaggctgcgctcggcgcctctctcgtgccttttcctcttggctctacagcgggagtgggccccgggggaaccgggaccggccccggggttcgcgtcggggcggcgaggcttgggacgtggagcgcaatccccggggctccggactctacgtttccccttttggggcgcttccttcctggggaccgtcctcctccggctcttggctctgggcagtccgggggaagaggtcggggttctctggcgaggtcccctgccttcatcgggagggtttgcacggaaggggcccgggaagcccaggcgggccgaacgccgaccgagtcagtctacccgagcctggcggcgggggactggtgtgggctgcagctgtggtgattgatgtgccttcgacctgcacggcaaccacgtcaccatctcctggcgtctttgggcttaattttgtgcgggaatccactttggggtggaacgtttgctgctggagccgggggagatacctttattctgacacttaaaaaaaaaaactatttgaaaaatatttgtcaagaaaaattcagcagtagcaggttggactgcaccgaggaaggattgcggcgagagcgggcgctggtaattttcatttgcagcgcgccctctctatgattggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 1866 - DNA, 3182 bp, Homo sapiens
gagccagggggcgtgggggctgggacagcaggccgattggcagggcggggttgccttcaatcctggccactgctcttaatcgtccctctcctgcttcagggtggcattgtgtgtcccagagtgccggagcgagtcccagaagagaggcgaggctaagcccagagcgctgggttgcttcagcagggaagactcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaagtgggctggtattctctctatgcaaaatgtctgttttagttggaatgactgaaagaagaacagctgttcctgtgttcttcgtatatacacacaaaaaggagcgggcagggccgctcgatgcctttgctgtttagcttcctccagaggaggggacttgtaggaatctgccttccagcccagacccccagtgtattttgtccaagttcacagtagagtagggtagaaggaaagcatgtctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggcacgcacctgtagtcccagctacttgggagcctgaggcaggagaatcgcttgaacctgggaagtggaggttgagtgagccgggaccgtgccattgtactccagcctgggtgacagagcgagattccgtctcaaaaaaaaaaaaaaaaagcccacctgaaagcctgtctctttccactttgttggcccttccagtgggattatcgagcatgttgttttttcatagtgcctttttccttatttcaagggttgcttctgagtggtgttttttttttttttttaatttgttttgttttaaaataagttaaaggcagtccagagcttttcagccaatttgtctcctactctgtgtaaatatttttccctccgggcaggggagccagggtagagcaaaggagacaaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaatcctttaactctgcggatagcatttggtaggtagtgattaactgtgaataataaatacacaatgaattcttca

SEQ ID NO: 1867 - DNA, 964 bp, Homo sapiens
gcgcggagaacacaaagtaaaacttctgctgttcccagtcctgcagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagtttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagcagagagtatcagatgtacaattatggaaataagaacattacttgagcatgacacttctttcagtatattgcttgatgcttcaaataaagttttgtcttgggaagatga

SEQ ID NO: 1868 - DNA, 1373 bp, Homo sapiens
cgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgtttttttt

SEQ ID NO: 1869 - DNA, 1614 bp, Homo sapiens
acagcagttacactgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaatggagcgtttgttttcattt

SEQ ID NO: 1870 - DNA, 697 bp, Homo sapiens
gaaacttggtgtccaggggaggcccccggcggctggagcgcggcggcagcgggcgcagaggccggagggagaggaggcgaggggcggcccgagcgcggggcgggagcgaggccagcggtcatgtgcccgtgccccctgcaccgcggccgcggccccccggccgtgtgcgcctgcagcgcgggtcgcctggggctgcgctcgtccgccgcgcagctcaccgccgcccggctcaaggcgctaggcgacgagctgcaccagcgcaccatgtggcggcgccgcgcgcggagccggagggcgccggcgcccggcgcgctccccacctactggccttggctgtgcgcggccgcgcaggtggcggcgctggcggcctggctgctcggcaggcggaacttgtaggaacgcggggcttcttggtggggccggagccgagacccagccggagcgagcaacaggttggtgaaaaccctgtgtccttggagaaagctggttcccgttttccagagggggagcccagagcttgaaaggccgcggttggcacttcgagaaggaagtggagagtaaagacagcgcctggagcgatcgtagaaacacagaatgggactggggaagccctttggaaatccagctgcagaaacagacaccccaatgctatttacatacagctctatatatataaaaaaagaaaatatgaatatta

SEQ ID NO: 1871 - DNA, 909 bp, Homo sapiens
gctgggggaggagtgcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgt

SEQ ID NO: 1872 - DNA, 672 bp, Homo sapiens
gcacttttctgagcagacgtccagagcagagtcagccagcatgaccgagcgccgcgtccccttctcgctcctgcggggccccagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacc

SEQ ID NO: 1873 - DNA, 2544 bp, Homo sapiens
gggccagtttggaaaaagattactgagttggagccgtctcaaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattgaagcagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgtgtgatgtatttgaatgtctgttatttccagccaccctaacattcttcttcctgtgtggatgcttatttgtcaatcagtaaatttgttcgtaaagaaaattacttctggtatttaggctgtgaatgtaccttgaaggggagagttcatggagagagcatgtgttctctgattgtgaggtcactgtgaatgattaaattggtaagggtaaagta

SEQ ID NO: 1874 - DNA, 1984 bp, Homo sapiens
aaatttgcagggagggacggggtggggggtggggggaccccggttgtgcagtttgatattgagggagcccccacctactcgctggggctgcgtaatctggacgtttccaaactgaagcgaaggcgtcgggagactaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaa

SEQ ID NO: 1875 - DNA, 2019 bp, Homo sapiens
aaactcgacgcgccggtgcctgcagccgcacaggttcgctctgggaagccttgggacaacgggagtcactctcgaaaaaggcctcagagaaccatggctactgccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctggggctggagacggctgggggcgtgatgactgccctgataaagcgcaactccaccatccccaccaagcagacacagattttcaccacctactctgacaaccaacccggggtgctgatccaggtgtatgagggcgagagggccatgacaaaggacaacaacctgctggggcggtttgacctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattgaagcagatgtgtaaccctatcatcacaaaactctaccaaggaggatgcactgggcctgcctgcggaacagggtatgtgcctggaaggcctgccacaggccccacaattgaagaagtagattaa

SEQ ID NO: 1876 - DNA, 696 bp, Homo sapiens
gccaagggaatcgccataggcatcgacctgggcaccacctactcctgtgtgggggtgttccagcacggcaaggtggagatcatcgccaacgaccagggcaaccgcaccacccccagctacgtggccttcacagacaccgagcggctcattggggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaaggggctccacccgcatccccaaggtgcagcggctgcttcaggactacttcaatggacgtgatc

SEQ ID NO: 1877 - DNA, 3348 bp, Homo sapiens
gtgccgcggcaacggcgcatgcgtaggcgcgcggccgcggcggcggctggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacacgtaggcacagaaaacaggaatgcagacaacatgcatcccctgcgtccatgagttacatgtgttctcttagtgtccacgttgttttgatgttattcatggaataccttctgtg

SEQ ID NO: 1878 - DNA, 3510 bp, Homo sapiens
gggtgtggcctccgggcggcatggctgcttcccaggtgatgccggcttcagctagtggggtctagttgaccgttccgcagccgccagggccagcggaaagccggtcagggggaaccgcggcggggctggtgtcatgagcctgaggtgaacttgagggtgcctcctcagcggtctcccgccctgccctgaggggcgccgggaccccaaagagcggaggaagagcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagcagggcacctgttaactggtaccaagaaaaggcccaagtgtttctctggcatctgatggtgtctggatccaccactctactctgtctctggaaacagcccttccacgtctctgcattccctgtcaccgcgtcactggccttcagacagagccaaggtgcagggcaacacctctacaaggatctgcagccatttatattgcttaggctactgatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaag

SEQ ID NO: 1879 - DNA, 1710 bp, Homo sapiens
ggttgagacgttcgcctttcaggcagaaattgcccagttgatgtcattgatcatcaatactttctactcgaacaaagagatctttctgagagagctcatttcaaattcatcagatgtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtatgtgaatacagcatttcctgatcattgatacttctaaggtgctttcaagcttagtcatacatagcccattttcgcatgttttcaacttaaaacagaaaactatgttgtgtgtggctgggcgcggtggctcacgcctgcaatcccagcactttgggaggctgaggcagcggatcacaaggtcaggagatcgagaccatcctggctaacacggtgaaactcagtctctactaaaaatagaaaaaaataaaccaggcgtggtggcacggcctgtaatcctagccacttgggaggctgaggcaggagaatcgcctgaacccaggaggcggaggttgcagtgagccaagatcgcaccactgcactccagcc

SEQ ID NO: 1880 - DNA, 2858 bp, Homo sapiens
gattggtgggttcatgtttcccgtcccccgcccgcgggaagtgggggtgaaaagcggcccgacctgcttgcggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaaactgtctgggactgggaacttatgaatgatatcaaaccaatatggcagagaccatcaaaagaagtagaagaagatgaatacaaagctttctacaaatcattttcaaaggaaagtgatgaccccatggcttatattcactttactgctgaaggggaagttaccttcaaatcaattttatttgtacccacatctgctccacgtggtctgtttgacgaatatggatctaaaaagagcgattacattaagctctatgtgcgccgtgtattcatcacagacgacttccatgatatgatgcctaaatacctcaattttgtcaagggtgtggtggactcagatgatctccccttgaatgtttcccgcgagactcttcagcaacataaactgcttaaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcccgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgtataaaaataaaaaagatcccaaata

SEQ ID NO: 1881 - DNA, 2035 bp, Homo sapiens
gaaaagcggcccgacctgcttgcggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagcagccaaagaagagaaagaagaatctgatgatgaagctgcagtagaggaagaagaagaagaaaagaaaccaaagactaaaaaagttgaaaaaactgtctgggactgggaacttatgaatgatatcaaaccaatatggcagagaccatcaaaagaagtagaagaagatgaatacaaagctttctacaaatcattttcaaaggaaagtgatgaccccatggcttatattcactttactgctgaaggggaagttaccttcaaatcaattttatttgtacccacatctgctccacgtggtctgtttgacgaatatggatctaaaaagagcgattacattaagctctatgtgcgccgtgtattcatcacagacgacttccatgatatgatgcctaaatacctcaattttgtcaagggtgtggtggactcagatgatctccccttgaatgtttcccgcgagactcttcagcaacataaactgcttaaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaattactatgcgagtcagaagaaaacatttgaaattaatcccagacacccgctgatcagagacatgcttcgacgaattaaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtggaagaagagcccgaagaagaacctgaagagacagcagaagacacaacagaagacacagagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgt

SEQ ID NO: 1882 - DNA, 1338 bp, Homo sapiens
gaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaagaagctattcagttggatggattaaatgcatcacaaataagagaacttagagagaagtcggaaaagtttgccttccaagccgaagttaacagaatgatgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagcaagacgaagatgaagaaatggatgtgggaacagatgaagaagaagaaacagcaaaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgt

SEQ ID NO: 1883 - DNA, 1822 bp, Homo sapiens
gtgtgtgtgtgtgtgtgtgtgtgtgtgtgtatgtgtgtgtgtgtgtgtgtgtgtgtgtgttttctctaaaagtcctatggccagactttgtttcccaagggtcatatgactgctcctctccaccccacactggcccggggcgggctgggcgcgggcccctgcgggtgttgcaacgcccggccagaaagtgggcatcagctgttccgcctggcccacgtgacccgccgagcataaatgtgaccggccgcggctccggcagtcaacgcctgcctcctctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaa

SEQ ID NO: 1884 - DNA, 921 bp, Homo sapiens
cggggacttagtctcctccctgggtttggacactggcatcctgctttatgtgtgacaccactgcacccctctgagcctcggtttccccatctgtaaaatagaagcgatctaccctcacagggtcatatgactgctcctctccaccccacactggcccggggcgggctgggcgcgggcccctgcgggtgttgcaacgcccggccagaaagtgggcatcagctgttccgcctggcccacgtgacccgccgagcataaatgtgaccggccgcggctccggcagtcaacgcctgcctcctctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaac

SEQ ID NO: 1885 - DNA, 2082 bp, Homo sapiens
ctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaa

SEQ ID NO: 1886 - DNA, 1806 bp, Homo sapiens
ctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggagggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatga

SEQ ID NO: 1887 - DNA, 1742 bp, Homo sapiens
ctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggagggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatga

SEQ ID NO: 1888 - DNA, 2101 bp, Homo sapiens
accacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaa

SEQ ID NO: 1889 - DNA, 2217 bp, Homo sapiens
ggagttagcctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggggcaaccgctgtcatgagttacagtccttccaggatgtgcctctgaaaatggattgcatataaatgatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttacc

SEQ ID NO: 1890 - DNA, 2215 bp, Homo sapiens
ggagttagcctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccagacaaacaaagcaaaaccgctcaagtcttgaggtggcaaatctttcccagttcccaccagaagaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttacc

SEQ ID NO: 1891 - DNA, 4615 bp, Homo sapiens
aaggagaaaagggcgctggggctcggcgggaggaagtgctagagctctcgactctccgctgcgcggcagctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgacactgaatttttcaagtatactaagagtaaagcaactcaagttataggaaaggaagcagataccttgcaaagcaactagtgggtgcttgagagacactgggacactgtcagtgctagatttagcacagtattttgatctcgctaggtagaacactgctaataataatagctaataataccttgttccaaatactgcttagcattttgcatgttttacttttatctaaagttttgttttgttttattatttatttatttatttattttgagacagaatctctctctgtcacccaggctggagtgccatggtgcgatcttggctcactgcaactttaagcaattctcctgcctcagcttcctgagtagctgggattataggcgtgtgccaccacgcccagctactttctatattttttgtagagatggagtttcgccatattggccaagctggtctcgaactcctgtcctcgaactcctgtcctcaagtgatccacccgcctcagcctctcaaagtgctgggattacaggtgtgagccaccacacccagcagtgttttatttttgagacagggtatcattctgttgcccaggcttgagtgcagtggtgcaatcatagatcactgcagccttttaactcctgggctcaagtcatcctcctgcttagcctcccaagtagctaggaccacagacacatgccatcacacttggctatttttaaaaaattttttgtagagatggggtctcgctatgttacccaaactggtcctgaactcctggactcaattgatcctcccaccttggccttccaggtgctgggatttctttgggagtacagcatggtacagcaggagatcatttgatgttacctctgtgcagtgttgctagtcagcgaaagactataatacctgtggggacagcgattagccaccacaaccagtctttatttaaagttattaaaaatggctgggcgcagtggctcacacctgtaatcctagcactttgggaggccgaggcagatggatcacctgacgtgaggaatttgataccagcctggccaacatggtgaaaccccatctctactaaaaaatacaaaaattagctgggtgtggtcctgtagtcccagctacttgggaggctggggcaggagaattacttgaacccaggaggcagaggttgcagtgagccgagattgtgccactgcactccagcctgggtgacagagagagattccatctcaaaaaaacaagttattaaaaatgtatatgaatgctcctaatatggtcaggaagcaaggaagcgaaggatatattatgagttttaagaaggtgcttagctgtatatttatctttcaaaatgtattagaagattttagaattctttccttcatgtgccatctctacaggcacccatcagaaaaagcatactgccgttaccgtgaaactggttgtaaaagagaaactatctatttgcaccttaaaagacagctagattttgctgattttcttctttcggttttctttgtcagcaataatatgtgagaggacagattgttagatatgatagtataaaaaatggttaatgacaattcagaggcgaggagattctgtaaacttaaaattactataaatgaaattgatttgtcaagaggataaattttagaaaacacccaataccttataactgtctgttaatgcttgctttttctctacctttcttccttgtttcagttgggaagcttttggctgcaagtaacagaaactcctaattcaaatggcttaagcaataaggaaatgtatattcccacataactagacgttcaaacaggccaggctccagcacttcagtacgtcaccagggatctgggttcttcccagctctctgctctgccatctttagcgctggcttcattctcagactctggtagcatgatggctgtagctgtttcatgggccccttcaaacctcatagcaaccagaggaagaaaatgagccattttttgagtctccttcatagacttgaataactctttttcagagcttctcacagcaaacctctcctcatgtctcctcatgtcttattgttcagaaatgggtaatgtggccatttcaccagtcactgccaacaacaacgaggttcctataattgtctctgagtaaccctttggaatggagagggtgttggtcagtctacaaactgaacactgcagttctgcgctttttaccagtgaaaaaatgtaattattttcccctcttaaggattaatattcttcaaatgtatgcctgttatggatatagtatctttaaaattttttattttaatagctttaggggtacacactttttgcttacaggggtgaattgtgtagtggtgaagactcggcttttaatgtacttgtcacctgagtgatgtacattgtacccaataggtaatttttcatccattaccctccttccgccctcttcccttctgagtctccaacatcccttataccactgtgtatgttcttgtgtacctacagctaagcttccacttataagtgagaacatgcagtatttggttttccattcctgagttacttcccttaggataacagcccccagttccgtccaagttgctgcaaaatacattattcttctttatggctgagtaatagtccatggtacatatataccacattttctttatccacttatcagttgatggacacttaggttaattccattcaatttcattcaatttaagtatatttgtaaggagctaaagctgaaaattaaattttagatctttcaatactcttaaattttatatgtaagtggtttttatattttcacatttgaaataaagtaatttttataatcttga

SEQ ID NO: 1892 - DNA, 4652 bp, Homo sapiens
ccagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgacactgaatttttcaagtatactaagagtaaagcaactcaagttataggaaaggaagcagataccttgcaaagcaactagtgggtgcttgagagacactgggacactgtcagtgctagatttagcacagtattttgatctcgctaggtagaacactgctaataataatagctaataataccttgttccaaatactgcttagcattttgcatgttttacttttatctaaagttttgttttgttttattatttatttatttatttattttgagacagaatctctctctgtcacccaggctggagtgccatggtgcgatcttggctcactgcaactttaagcaattctcctgcctcagcttcctgagtagctgggattataggcgtgtgccaccacgcccagctactttctatattttttgtagagatggagtttcgccatattggccaagctggtctcgaactcctgtcctcgaactcctgtcctcaagtgatccacccgcctcagcctctcaaagtgctgggattacaggtgtgagccaccacacccagcagtgttttatttttgagacagggtatcattctgttgcccaggcttgagtgcagtggtgcaatcatagatcactgcagccttttaactcctgggctcaagtcatcctcctgcttagcctcccaagtagctaggaccacagacacatgccatcacacttggctatttttaaaaaattttttgtagagatggggtctcgctatgttacccaaactggtcctgaactcctggactcaattgatcctcccaccttggccttccaggtgctgggatttctttgggagtacagcatggtacagcaggagatcatttgatgttacctctgtgcagtgttgctagtcagcgaaagactataatacctgtggggacagcgattagccaccacaaccagtctttatttaaagttattaaaaatggctgggcgcagtggctcacacctgtaatcctagcactttgggaggccgaggcagatggatcacctgacgtgaggaatttgataccagcctggccaacatggtgaaaccccatctctactaaaaaatacaaaaattagctgggtgtggtcctgtagtcccagctacttgggaggctggggcaggagaattacttgaacccaggaggcagaggttgcagtgagccgagattgtgccactgcactccagcctgggtgacagagagagattccatctcaaaaaaacaagttattaaaaatgtatatgaatgctcctaatatggtcaggaagcaaggaagcgaaggatatattatgagttttaagaaggtgcttagctgtatatttatctttcaaaatgtattagaagattttagaattctttccttcatgtgccatctctacaggcacccatcagaaaaagcatactgccgttaccgtgaaactggttgtaaaagagaaactatctatttgcaccttaaaagacagctagattttgctgattttcttctttcggttttctttgtcagcaataatatgtgagaggacagattgttagatatgatagtataaaaaatggttaatgacaattcagaggcgaggagattctgtaaacttaaaattactataaatgaaattgatttgtcaagaggataaattttagaaaacacccaataccttataactgtctgttaatgcttgctttttctctacctttcttccttgtttcagttgggaagcttttggctgcaagtaacagaaactcctaattcaaatggcttaagcaataaggaaatgtatattcccacataactagacgttcaaacaggccaggctccagcacttcagtacgtcaccagggatctgggttcttcccagctctctgctctgccatctttagcgctggcttcattctcagactctggtagcatgatggctgtagctgtttcatgggccccttcaaacctcatagcaaccagaggaagaaaatgagccattttttgagtctccttcatagacttgaataactctttttcagagcttctcacagcaaacctctcctcatgtctcctcatgtcttattgttcagaaatgggtaatgtggccatttcaccagtcactgccaacaacaacgaggttcctataattgtctctgagtaaccctttggaatggagagggtgttggtcagtctacaaactgaacactgcagttctgcgctttttaccagtgaaaaaatgtaattattttcccctcttaaggattaatattcttcaaatgtatgcctgttatggatatagtatctttaaaattttttattttaatagctttaggggtacacactttttgcttacaggggtgaattgtgtagtggtgaagactcggcttttaatgtacttgtcacctgagtgatgtacattgtacccaataggtaatttttcatccattaccctccttccgccctcttcccttctgagtctccaacatcccttataccactgtgtatgttcttgtgtacctacagctaagcttccacttataagtgagaacatgcagtatttggttttccattcctgagttacttcccttaggataacagcccccagttccgtccaagttgctgcaaaatacattattcttctttatggctgagtaatagtccatggtacatatataccacattttctttatccacttatcagttgatggacacttaggttaattccattcaatttcattcaatttaagtatatttgtaaggagctaaagctgaaaattaaattttagatctttcaatactcttaaattttatatgtaagtggtttttatattttcacatttgaaataaagtaatttttataatcttga

SEQ ID NO: 1893 - DNA, 801 bp, Homo sapiens
atgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgacactg

SEQ ID NO: 1894 - DNA, 1571 bp, Homo sapiens
ccagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaagaagctctgtagatgtgctatacacttttgcaaactgctcaggactggacttgatctttggcctaaatgcgttattaagaacagcagatttgcagtggaacagttctaatgctcagttgctcctggactactgctcttccaaggggtataacatttcttgggaactaggcaatgaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctgaaaataaaatatactagtcctgaca

SEQ ID NO: 1895 - DNA, 1458 bp, Homo sapiens
atgctgctgcgctcgaagcctgcgctgccgccgccgctgatgctgctgctcctggggccgctgggtcccctctcccctggcgccctgccccgacctgcgcaagcacaggacgtcgtggacctggacttcttcacccaggagccgctgcacctggtgagcccctcgttcctgtccgtcaccattgacgccaacctggccacggacccgcggttcctcatcctcctgggttctccaaagcttcgtaccttggccagaggcttgtctcctgcgtacctgaggtttggtggcaccaagacagacttcctaattttcgatcccaagaaggaatcaacctttgaagagagaagttactggcaatctcaagtcaaccaggatatttgcaaatatggatccatccctcctgatgtggaggagaagttacggttggaatggccctaccaggagcaattgctactccgagaacactaccagaaaaagttcaagaacagcacctactcaaaacctaacagtttccttaagaaggctgatattttcatcaatgggtcgcagttaggagaagattttattcaattgcataaacttctaagaaagtccaccttcaaaaatgcaaaactctatggtcctgatgttggtcagcctcgaagaaagacggctaagatgctgaagagcttcctgaaggctggtggagaagtgattgattcagttacatggcatcactactatttgaatggacggactgctaccaaggaagattttctaaaccctgatgtattggacatttttatttcatctgtgcaaaaagttttccaggtggttgagagcaccaggcctggcaagaaggtctggttaggagaaacaagctctgcatatggaggcggagcgcccttgctatccgacacctttgcagctggctttatgtggctggataaattgggcctgtcagcccgaatgggaatagaagtggtgatgaggcaagtattctttggagcaggaaactaccatttagtggatgaaaacttcgatcctttacctgattattggctatctcttctgttcaagaaattggtgggcaccaaggtgttaatggcaagcgtgcaaggttcaaagagaaggaagcttcgagtataccttcattgcacaaacactgacaatccaaggtataaagaaggagatttaactctgtatgccataaacctccataatgtcaccaagtacttgcggttaccctatcctttttctaacaagcaagtggataaataccttctaagacctttgggacctcatggattactttccaaatctgtccaactcaatggtctaactctaaagatggtggatgatcaaaccttgccacctttaatggaaaaacctctccggccaggaagttcactgggcttgccagctttctcatatagtttttttgtgataagaaatgccaaagttgctgcttgcatctga

SEQ ID NO: 1896 - DNA, 3664 bp, Homo sapiens
agtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggagaaaactttagaaactgttcctttggagaggaaaaagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtattgcagaaataccataccatcaatggtcataatgcagaagtaagaaaggctttgtctagacaagaaatgcaggaagttcagagttctaggagtggaagaggaggcaactttggctttggggattcacgtggtggcggtggaaatttcggaccaggaccaggaagtaactttagaggaggatctgatggatatggcagtggacgtggatttggggatggctataatgggtatggaggaggacctggaggtggcaattttggaggtagccccggttatggaggaggaagaggaggatatggtggtggaggacctggatatggcaaccagggtgggggctacggaggtggttatgacaactatggaggaggaaattatggaagtggaaattacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaattgtgtaattatagactttttattttaaataagttaaggagtgggtagtataattaaggtccgttgcaaagctgttgttatatttgtataagataaatgctggtcagatgtaagtgtgttgtctgcaattcatcaggattaaattatgtagataacttaagggatatctctgcaaggagaaacacctttttagatcttttagatgctgcttcttcaatgcaaggaaaggaaataaccccagcgaggtactcttcagggacacaggtctagtacaagagaactcttgacggctactaagttcagccagtcttaaaaaactgtgctgtttctacaaaactttaactacagtagtttataaggatgccaacgaaagctgagggtgtagagcaaaatagttctaagcttcagttaaacttctttaggtaagatcttatttacttttcctttcttaattttcctccctaaaagataaactaatactcttaaatggtctttcagtatagtggttcttacgtagtttaacatagctataaattgagtttaacaatttataaactcaagagaataatttttataaaccctgttttccaatctgtcatttacttaaattattttggttgtttttccctttttttccttcttttcccaccccctccccctccatgtgaagatttgggtgcttaacatatcatttttttccctgccggaattttagcattgatatgaaccatggacaagtatattctgctgccacaaagactgtaaagtgcttcatttcaacagctgaggcaagccaagtgatcattaataaagcttttcttggttccttcagtggtgttggtagtaaaatggtaggtaaaagttaggctgcaagttcaataaatcatgagatttcccatcgttacacccttgtgtattcacatttcttggatcaaacattttgagtgaactaggggtttttattaaagacatttgttgtatttatggttgtaactgtacatgcttatcaggatgagactgaaagaaggtagggcaaaaatggttgaatctattttcagatagtagttcatacttgagtgaagtgtcttgtctgcattatgaagcctggtatgtatccagtactaaataggtgggttaaatgtggtaattctagttcagtgtcttaccctgaagagaaagttgtaggttggctgttgaaattcattccttagatatgatcagtttgattgcccggctttattgcctttacaggaatgtgatactcagggcttactctatacaccaatgagtcttctttgatcctaagaccaccactgaagttgtttaggttcttttggacaaacatgataaacttcttcagatactttttttttcctttggcaggaaggtgtcttgctgcaggtaactaatgaagaagtggtcaaccacagagtcttcaagaaataagaaattctgtaccatctgaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggttttgtgagtagacagattacaattctattttaaatataaagtttataaaataaatactttttgtatccaaatacttggtgtaatgtttacacataaaatgtgtgaatcttgttctataaatatttggttgtctaaaagatcaccatcccctaaatttttaaaagcagtttcacaaagctatgcatattttaatattaacaggtaaatgagaagagcattgtggacattattggctgtccccaataaaatgctgttcattatgcactgta

SEQ ID NO: 1897 - DNA, 1711 bp, Homo sapiens
agtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtattgcagaaataccataccatcaatggtcataatgcagaagtaagaaaggctttgtctagacaagaaatgcaggaagttcagagttctaggagtggaagaggaggcaactttggctttggggattcacgtggtggcggtggaaatttcggaccaggaccaggaagtaactttagaggaggatctgatggatatggcagtggacgtggatttggggatggctataatgggtatggaggaggacctggaggtggcaattttggaggtagccccggttatggaggaggaagaggaggatatggtggtggaggacctggatatggcaaccagggtgggggctacggaggtggttatgacaactatggaggaggaaattatggaagtggaaattacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaaggaaa

SEQ ID NO: 1898 - DNA, 1724 bp, Homo sapiens
agtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggagaaaactttagaaactgttcctttggagaggaaaaagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtattgcagaaataccataccatcaatggtcataatgcagaagtaagaaaggctttgtctagacaagaaatgcaggaagttcagagttctaggagtggaagaggaggcaactttggctttggggattcacgtggtggcggtggaaatttcggaccaggaccaggaagtaactttagaggaggatctgatggatatggcagtggacgtggatttggggatggctataatgggtatggaggaggacctggaggtggcaattttggaggtagccccggttatggaggaggaagaggaggatatggtggtggaggacctggatatggcaaccagggtgggggctacggaggtggttatgacaactatggaggaggaaattatggaagtggaaattacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatggcattgatatgaaccatggacaagtatattctgctgccacaaagactgtaaagtgcttcatttcaacagctgaggcaagccaagtgatcattaataaagcttttcttggttccttcagtggtgttggtagtaaaatggaaggtgtcttgctgcaggtaactaatgaagaagtggtcaaccacagagtcttcaagaaataagaaattctgtaccatctgaaagtagttcttgttggtgccttcatttaaaaagcactctttaaaataaaagggaaatgttttctgataaaacaaacatttagttgaggttcttgatataaaacaattacaaaatgagtgttgtttgtaaaacagtaacatcaaattggctagagagataaatgtatcatgttttaaattaggttttgtgagtagacagattacaattctattttaaatataaagtttataaaataaatactttttgtatccaaa

SEQ ID NO: 1899 - DNA, 1523 bp, Homo sapiens
gtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgatggagagagaaaaggaacagttccgtaagctctttattggtggcttaagctttgaaaccacagaagaaagtttgaggaactactacgaacaatggggaaagcttacagactgtgtggtaatgagggatcctgcaagcaaaagatcaagaggatttggttttgtaactttttcatccatggctgaggttgatgctgccatggctgcaagacctcattcaattgatgggagagtagttgagccaaaacgtgctgtagcaagagaggaatctggaaaaccaggggctcatgtaactgtgaagaagctgtttgttggcggaattaaagaagatactgaggaacatcaccttagagattactttgaggaatatggaaaaattgataccattgagataattactgataggcagtctggaaagaaaagaggctttggctttgttacttttgatgaccatgatcctgtggataaaatcgtattgcagaaataccataccatcaatggtcataatgcagaagtaagaaaggctttgtctagacaagaaatgcaggaggacctggaggtggcaattttggaggtagccccggttatggaggaggaagaggaggatatggtggtggaggacctggatatggcaaccagggtgggggctacggaggtggttatgacaactatggaggaggaaattatggaagtggaaattacaatgattttggaaattataaccagcaaccttctaactacggtccaatgaagagtggaaactttggtggtagcaggaacatggggggaccatatggtggaggaaactatggtccaggaggcagtggaggaagtgggggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatttatgatttaataaaataattctaaagg

SEQ ID NO: 1900 - DNA, 1197 bp, Homo sapiens
atgtcggaggagcagttcggcggggacggggcggcgggcaacggcggcggtaggcgggcgggcgagcaggagggagccatggtggcggcgacacagggggcagcggcgcgggaagcggagccgggaccgggggcggaaccgcgtctggaggcaccgaagggggccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtat

SEQ ID NO: 1901 - DNA, 3033 bp, Homo sapiens
aaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagtgttgagggaggattaaagaaatatataccgtgtttatgtgtgtgtgcttatttgtttgaatgattttattttccatttctcaaaggttttatttttttggttagggccttaaaatttcaggactgtgattattagtatgtgtgcctaaggaactttttgagtcactcttaagaaagtgaaactgaagagtctaagtgataactataggattaagtcagaattgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgatggaatacctttcttacttttgtggagttacatctgatgctaagaatttgacctccaactaagcaaacattttaatgagcaaaagttagtgttattaaagtttttttatgatagatccaaattgaggacctgtgtcctgtttttataagattgcaacccagctatgctcatttgtttatgttttgtatatggctgcttttgtgttacagtggtagagtttagtagttaggacagagacctgcaaagcaaaataatttacagtctggccctttacagaaaagtttgctgactcatggtcaaaataaatgaaaattttttgtgttagggttgttaagctagggttctttttggtatcatatgcttattttatgtaaatctctcaataaaaaattatttttaagaga

SEQ ID NO: 1902 - DNA, 1667 bp, Homo sapiens
ttttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtat

SEQ ID NO: 1903 - DNA, 1585 bp, Homo sapiens
ccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaa

SEQ ID NO: 1904 - DNA, 607 bp, Homo sapiens
ttaaaggcccccaaggctgtgcaacgcggagcgtgagaggaagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagcc

SEQ ID NO: 1905 - DNA, 748 bp, Homo sapiens
tgtgcaacgcggagcgtgagaggaagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataag

SEQ ID NO: 1906 - DNA, 1089 bp, Homo sapiens
gaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtgaccagcagagtggttatgggaaggtatccaggcgaggtggtcatcaaaatagctacaaaccatactaaattattccatttgcaacttatccccaacagcgggaacttcattgcaggccctgtgtcgcgctgacttcacgattctcacaggcccgctcaatgcggacagggtacgagatgctcacgctctcgaatgctgccgtttggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtat

SEQ ID NO: 1907 - DNA, 1411 bp, Homo sapiens
gtcggccattttaggtggtccgcggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagtttcggttcgcggcagcggcgggtgtagtctcggcggcagcggcggagacactagcactatgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaagggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatctatattgttcataaaacaatgcttaatttaagagtttcacagcacccagaagtgcttaccatattataacatagtgactttcaaagatatgtaacacaggtgctcttaagcttttgcctttttgtcctattattaacaagtcagtaaagttaacaggtaaagtactgctaat

SEQ ID NO: 1908 - DNA, 1263 bp, Homo sapiens
atgtcggaggagcagttcggcggggacggggcggcggcagcggcaacggcggcggcgtctggaggcaccgaagggggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtat

SEQ ID NO: 1909 - DNA, 3913 bp, Homo sapiens
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgcc

SEQ ID NO: 1910 - DNA, 2637 bp, Homo sapiens
agataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttt

SEQ ID NO: 1911 - DNA, 2804 bp, Homo sapiens
agacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgatt

SEQ ID NO: 1912 - DNA, 1626 bp, Homo sapiens
cgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagttcgttttcctgaagatcttgaaaatgacattagaactttctttcctgagtatacccatcaactctttggggatgatgaaactgcttttggttacaagggtctaaagatcctgttatactatattgctggtagcctgtcaacaatgttccgtgttgaatatgcatctaaagttgatgagaactttgactgtgtagaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgttaatgtgtgatgatatgattcttaaatacttacaataaacctcattcttaaata

SEQ ID NO: 1913 - DNA, 1570 bp, Homo sapiens
gagcgcgcgggttgattcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagtgaaactgcttttggttacaagggtctaaagatcctgttatactatattgctggtagcctgtcaacaatgttccgtgttgaatatgcatctaaagttgatgagaactttgactgtgtagaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggctgacatgacatgtagaggctttcgagaatatcatgaaaggcttcagacctttttgatgtggtttattgaaactgctagctttattgacgtggatgatgaaagatggcactactttctagtatttgagaagtataataaggatggagctacgctctttgcgaccgtaggctacatgacagtctataattactatgtgtacccagacaaaacccggccacgtgtaagtcagatgctgattttgactccatttcaaggtcaaggccatggtgctcaacttcttgaaacagttcatagatactacactgaatttcctacagttcttgatattacagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataagcaacacgctagaagggtttatgaaattcttcgactactggtaactgacatgagtgatgccgaacaatacagaagctacagactggatattaaaagaagactaattagcccatataagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgatatgttaatgtgtgatgatatgattcttaaatacttacaataaacctcattcttaaatactt

SEQ ID NO: 1914 - DNA, 1787 bp, Homo sapiens
agatcgaggctgagaccaagaggggatcgcgtgggggaagcgtgaggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcacctggggtccaaatgcaggcgattcctgaggacgccatccctgaggagagtggcgatgaggacgaagacgaccctgacaagcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaaccataaagggtgccaggtctgggtgaaagggatacttttatgcaaccataagacaaactcctgaaatgccaagtgcctgcttagtagctttggaaaggtgcccttattgaacattctagaa

SEQ ID NO: 1915 - DNA, 2124 bp, Homo sapiens
ctcccccctgggtcggacgctgagcggagccgcgggcgggagggcggacggaccgactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagattcaacgttggtgaggactgtccagtattcgatggcctgtttgagttctgtcagttgtctactggtggttctgtggcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcctatgaggccattttcaagccggtcatgtccaaagtaatggagatgttccagcctagtgcggtggtcttacagtgtggctcagactccctatctggggatcggttaggttgcttcaatctaactatcaaaggacacgccaagtgtgtggaatttgtcaagagctttaacctgcctatgctgatgctgggaggcggtggttacaccattcgtaacgttgcccggtgctggacatatgagacagctgtggccctggatacggagatccctaatgagcttccatacaatgactactttgaatactttggaccagatttcaagctccacatcagtccttccaatatgactaaccagaacacgaatgagtacctggagaagatcaaacagcgactgtttgagaaccttagaatgctgccgcacgcacctggggtccaaatgcaggcgattcctgaggacgccatccctgaggagagtggcgatgaggacgaagacgaccctgacaagcgcatctcgatctgctcctctgacaaacgaattgcctgtgaggaagagttctccgattctgaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgtttcttccccaacccctcagattttatattttctatttctctgtgtatttatataaaaatttattaaatataaatatccccagggacagaaaccaaggccccgagctcagggcagctgtgctgggtgagctcttccaggagccaccttgccacccattcttcccgttcttaactttgaaccataaagggtgccaggtctgggtgaaagggatacttttatgcaaccataagacaaactcctgaaatgccaagtgcctgcttagtagctttggaaaggtgcccttattgaacattctagaaggggtggctgggtcttcaaggatctcctgtttttttcaggctcctaaagtaacatcagccatttttagattggttctgttttcgtaccttcccactggcctcaagtgagccaagaaacactgcctgccctctgtctgtcttctcctaattctgcaggtggaggttgctagtctagtttcctttttgagatactattttcatttttgtgagcctctttgtaataaaatggtacatttctatatcctcctga

SEQ ID NO: 1916 - DNA, 664 bp, Homo sapiens
gactgacggtagggacgggaggcgagcaagatggcgcagacgcagggcacccggaggaaagtctgttactactacgacggggatgttggaaattactattatggacaaggccacccaatgaagcctcaccgaatccgcatgactcataatttgctgctcaactatggtctctaccgaaaaatggaaatctatcgccctcacaaagccaatgctgaggagatgaccaagtaccacagcgatgactacattaaattcttgcgctccatccgtccagataacatgtcggagtacagcaagcagatgcagagatcaagtgctgtgaaacttaataagcagcagacggacatcgctgtgaattgggctgggggcctgcaccatgcaaagaagtccgaggcatctggcttctgttacgtcaatgatatcgtcttggccatcctggaactgctaaagtatcaccagagggtgctgtacattgacattgatattcaccatggtgacggcgtggaagaggccttctacaccacggaccgggtcatgactgtgtcctttcataagtatggagagtacttcccaggaactggggacctacgggatatcggggctggcaaaggcaagtattatgctgttaactacccgctccgagacgggattgatgacgagtcct

SEQ ID NO: 1917 - DNA, 2960 bp, Homo sapiens
ggccttcctgcgggcaggctctctgtgtcgcaacactggcggggcgggccaaatcggccagagctctgcccccagaggacgcggctaagcccgggggcgtgtcctgggctggccccacccgcgccccgccccgccccgcccggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcagaagaagggtgggggacgtgggcaggccaggctcacaggtggaaatcagggatgcagggtggtgcccaagccaggtcctgcaggaacccaggcccagggagggacccagacactggtgaggcggggcaggggttcctggagagagggcagcgaggatctctatcctggcctggggattatgaacataggtagccggggcagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttca

SEQ ID NO: 1918 - DNA, 2043 bp, Homo sapiens
gcaggctctgagagcctacatgtcttcgccgggagtgcttgtcccggagctgctcgcagactgggccgggggtgggctcgggtcggagaggtcacggggctccttaggtcacaggcggcagggccagagaaactcccccgcccctacgtttaactcgcggaaacaagggcccagagagcccagacgccagcccaaggtcacacagcgaagccccggcacagcccgccgggaacctgtcgtttctaacccccagcctctcgccgtttctacccagcttgggaagcgcaggaacaggacatacggtggtcgcgccccttccgcgaggccggggtgaaacccgcttggccctcccgccagggggcggagcttccgaaccaggcgggattccaccgggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatgggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgc

SEQ ID NO: 1919 - DNA, 2766 bp, Homo sapiens
gctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagtggtcctttgctgttgctaccatcacagaaatcccccccgttatcttcctccccaacttccttgtgcagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcagaagaagggtgggggacgtgggcaggccaggctcacaggtggaaatcagggatgcagggtggtgcccaagccaggtcctgcaggaacccaggcccagggagggacccagacactggtgaggcggggcaggggttcctggagagagggcagcgaggatctctatcctggcctggggattatgaacataggtagccggggcagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgt

SEQ ID NO: 1920 - DNA, 1021 bp, Homo sapiens
ggtcgcggagctgcggccagctttgggagggccggccccgggatgctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagtt

SEQ ID NO: 1921 - DNA, 1559 bp, Homo sapiens
agggcgagggcggggacggccgggcgggcgcgccaggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaagaagagaagcttctgtctgacagcatgctggtggaggcgcgggaggcctcggaggaggacctgctggtggtgcacacgaggcgctatcttaatgagctcaagaggaaggtgctgaggccccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatcattgatcttgatgcccatcagggcaatgggcatgagcgagacttcatggacgacaagcgtgtgtacatcatggatgtctacaaccgccacatctacccaggggaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagca

SEQ ID NO: 1922 - DNA, 2084 bp, Homo sapiens
tttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacgccttcaccctgccatttctagtgaatctgtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttgg

SEQ ID NO: 1923 - DNA, 6656 bp, Homo sapiens
agtggatgcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttggattatcttttgtctgtttattactacaatatgaagtcttgtttcagtggctaatgacatcatttctgtagacttacaatacactctaggtgaaagataatgattacagcttgaaagataactatttgctgtttctttgggaagagtatttatagtaattattacttatctttgcaatagaaattctaccaccttgccctctatagcttagccagttagtatcagtgaagattaacatcccattacaatttatgaaataatacagactctgcaattgagatgtaggagttctttgagttgacccaaagattctcaaaattgaaatggaaattctgaattgaaagaagaaactgaccagaacttgtattgaccagacttgcctatagtatattgctggtttaaaatggaacctgcagacaaaacctgtttcttttactgcatttacatggcatccaggttccattattatttacgtgacatccaggtttctaactcaaggaaataaacacaactgatttatcattcagcaactacttattgtgtgtctgcccattttaagactgtaggagtgtaactgaatataatggaaaaatgctttcactcagagcttacactcagagcttacattctagtagcaggaagcagacaaatgggggtaactcctgctactaagatgtgcaaagaagacaaaacattttaggaacttgccaaaatcagtgaaatctccctttttgtcaggcccacattgattcttttgagattaaaaattacagaatgccagaagataattcagtcaaaagtatttctcttcagtgcagtaaaatattaaaagaaaaaatatttctctacaagcctcttaaatgtttcagacattcacaatagcacctagacttttgtaatgaacagctgtgcacccaccccgacttaacaaatattttacttttgctatatttgcttcggtgtttttttcttaaaatacaccgaaattgaagctctctttgtgtactttgtcgtttgtaatcctccctccctcccagccttaagaagtaatcaccattgtgattattttatccatgtttttgtgaatattttacccatgtttttgtacttttgctacatatttgttatcaatctgtaaacctttatgacattaggaactaagaaacttagtcccttcgttagggggataatgaaatgtatttagtgtttgtgaaacatagatggtatgtatttggacaattctgtaactttgctttttttatttttatttttccatagcttattggggaacaggtggtgtttggttacatgattaagttctttagtggtgatttgtgggattttggtggacccatcacccaagcagtgtacactgcaccctatttgtaatcttttatccctcgcccccctcccaccatgcctcccgtctaccatgatgatcctgttttaaataagaaaataccatttcgcaggctccagatgttctggcatcctccctgtggatttcccagtgcctgcagctcacaggacaacaggggctgtggtagagtcacctatgagatcctggagtagtggatggaggagatggaacagtgaagacggaaactgagctcagtatccgggtgccaggagacaaaggccctttgctttttttcatttaatattctgatctacccctgttgacacatgttaagtatagttcattttgactgctatgtattatgttccattgtgtgaacatactgaaattgtacacttcaatactatactggatctccttgggtgtatttaagaggttttgtttttctaagtagttggttatatacaactaaaacctcaagagaactatctaaagcaatttcagcaaggtgatttggtacagcattaataaacagaaatcagtaacacttagtgaccaagtctgttggaagaacaaagacccccatttgtaataacaaaatttttagaaataatatgtaaagaagctatggttcttgtgtctagtaaggtcaatgtaacatagtaagatgtcagaataccctaatactttaaaaaattcatataggataaaaatgatatttgaaattggcaaggaaagacattattttgtaagtggaattgggacaacaactggtaaccaaatggaaaacccagttttctgccctccactagaagatttaaataggaaaagataaaactaccaaaaacctaaactcttaaagcaaatggattgaagaaggcctaagtgtgacaccaaactcaactataaaagatatatttgataacaaaaaaaaaattagttcagtggaccaacaaaaacttagaagacaagtcaagaaaaatgacaaaagacagagtgggaggcagatttgtaactcatccaggtcaaaaggctcatatctaaagatagtagaggaacaaaatgtataaggatgtgaactgggaaacaaatacatataaatagtttgtaaatatgaaaagatctttaacctcagtaaataaaaagctatagagagacttattttttaacttagttttttaaacctattatgtttatttattttttctttttttgagacggagtctcgctgttgcccaggctggtgtgcaatggcgcaatctcggctcactgcaacctccgcctcccaggttgaagccattctcctgcctcagcctcctgagtagctgggattacaggcgcctgtcaccacgcccagctaattgttcgcatttttagtagagacggggtttcactatgttggccaggctggcctcgaactcctgacctcatgatccacccaccttggccttccaaagtgctgggattacaggtgtgagctgccgcacctggctgtttatctcttttttttagagaaaggatctcggtcacccaggatggagtgtggtagcctgatcatatctcactacatcttagaacttctaggcttagggtattctcccacctcagcctcccaagtagctgggactacaagtgtgcaccatcacacctagctgatttttacatttttattttggagagatggtgtctccctgtgttgcccaggctggtcacaaactcctaggctcaagcgattctcctgactcaggcatgagccaccgtacccggcctaaacctatcatgttacagacttagaaagcaactattgtcaagtgtttgaggaaactcaggtcaggtttggtaaactaagatattaactcaagtaaagctctttaattcatttaatgaaggtgccacattgtctcagttctctatggcatgggtgaatgctgttctaagtcagcattggtactctaagctagttacatcatatctaagctttgcccttctaccagagctgctagcattctgtcaatgggcaattatttgaagttcttacattgaagttagtcacctacatcttctgttttttatggttttgatgtagtaatactgctgaagtttttttgataactgcgattcataatatttgttattcatattgtgatataaatgataagggcttttgaaaacaagtagtaatcatttcaatagcttaggatctccaccataatcttaggaaaattactaacctctgtgcctcagttgcttcatcatttaaaatgaggaaaataatagtccctacttaataggtttgttgtgaggattgagttaataacatagttaatgctcagtaagggttagctgctatttttttttcttttttttttgaaagagtctcactctgttgcccaggttggagtgcagtggcatgatcttggctcactgcatcctctgcttcctaggttcaggtgattctcatgcttcagcctcccaagcagctgggagtacaggtgtgcaccaccacacctggctaatttttgtatatttagtagagacgggttctcaccatattgtccaggctggtcttgaactccttacctcaaatgatccacccgcctgggcctcccaaagtgctgggattacaagcatgagccaccgcgcctggcttgctattgttatgaggtaaaggtagatagatgggtgagagtggtgccaggggaagtgttaaatttttgagtgttcctttagatgccagatgggttgtatctgagccttttattgcagtttgatgcctactagtgtgaagactactaggtcatagtggatagagaagcaatcttttggagacctgattttagcaaggatacgaataatatttgacaactttggggggatcttgatgcctctgtaatttactcaaggataatctcaagaaaaatggcattaagtagattacagaaaaaatagaactatcatattgttattattggctatttacatgagcaatgcggagaaatgtttaggattacagcatttagaagcttctcaattgctgcatttcctcactgtaccacaagatggcagatactgcatttaaaatttttttttctgtgtgttttctcttatagtcacttggtggccatgtaacaagcagagcaacatgtattaacagattctttttgaatgcaatattggattaaaaactttgaattaaactacaa

SEQ ID NO: 1924 - DNA, 9874 bp, Homo sapiens
gcaggttgttcaccctaacagggcctctaacctcgagcccgaaacggcctccttctccagccgtgccccttcctcccccgtggaggccgcagtggatgcgctcacctccctgcggcctcctgaggtggtttggtggccccctcctcgcgagttggtgccgctgccacctccgattccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttggattatcttttgtctgtttattactacaatatgaagtcttgtttcagtggctaatgacatcatttctgtagacttacaatacactctaggtgaaagataatgattacagcttgaaagataactatttgctgtttctttgggaagagtatttatagtaattattacttatctttgcaatagaaattctaccaccttgccctctatagcttagccagttagtatcagtgaagattaacatcccattacaatttatgaaataatacagactctgcaattgagatgtaggagttctttgagttgacccaaagattctcaaaattgaaatggaaattctgaattgaaagaagaaactgaccagaacttgtattgaccagacttgcctatagtatattgctggtttaaaatggaacctgcagacaaaacctgtttcttttactgcatttacatggcatccaggttccattattatttacgtgacatccaggtttctaactcaaggaaataaacacaactgatttatcattcagcaactacttattgtgtgtctgcccattttaagactgtaggagtgtaactgaatataatggaaaaatgctttcactcagagcttacactcagagcttacattctagtagcaggaagcagacaaatgggggtaactcctgctactaagatgtgcaaagaagacaaaacattttaggaacttgccaaaatcagtgaaatctccctttttgtcaggcccacattgattcttttgagattaaaaattacagaatgccagaagataattcagtcaaaagtatttctcttcagtgcagtaaaatattaaaagaaaaaatatttctctacaagcctcttaaatgtttcagacattcacaatagcacctagacttttgtaatgaacagctgtgcacccaccccgacttaacaaatattttacttttgctatatttgcttcggtgtttttttcttaaaatacaccgaaattgaagctctctttgtgtactttgtcgtttgtaatcctccctccctcccagccttaagaagtaatcaccattgtgattattttatccatgtttttgtgaatattttacccatgtttttgtacttttgctacatatttgttatcaatctgtaaacctttatgacattaggaactaagaaacttagtcccttcgttagggggataatgaaatgtatttagtgtttgtgaaacatagatggtatgtatttggacaattctgtaactttgctttttttatttttatttttccatagcttattggggaacaggtggtgtttggttacatgattaagttctttagtggtgatttgtgggattttggtggacccatcacccaagcagtgtacactgcaccctatttgtaatcttttatccctcgcccccctcccaccatgcctcccgtctaccatgatgatcctgttttaaataagaaaataccatttcgcaggctccagatgttctggcatcctccctgtggatttcccagtgcctgcagctcacaggacaacaggggctgtggtagagtcacctatgagatcctggagtagtggatggaggagatggaacagtgaagacggaaactgagctcagtatccgggtgccaggagacaaaggccctttgctttttttcatttaatattctgatctacccctgttgacacatgttaagtatagttcattttgactgctatgtattatgttccattgtgtgaacatactgaaattgtacacttcaatactatactggatctccttgggtgtatttaagaggttttgtttttctaagtagttggttatatacaactaaaacctcaagagaactatctaaagcaatttcagcaaggtgatttggtacagcattaataaacagaaatcagtaacacttagtgaccaagtctgttggaagaacaaagacccccatttgtaataacaaaatttttagaaataatatgtaaagaagctatggttcttgtgtctagtaaggtcaatgtaacatagtaagatgtcagaataccctaatactttaaaaaattcatataggataaaaatgatatttgaaattggcaaggaaagacattattttgtaagtggaattgggacaacaactggtaaccaaatggaaaacccagttttctgccctccactagaagatttaaataggaaaagataaaactaccaaaaacctaaactcttaaagcaaatggattgaagaaggcctaagtgtgacaccaaactcaactataaaagatatatttgataacaaaaaaaaaattagttcagtggaccaacaaaaacttagaagacaagtcaagaaaaatgacaaaagacagagtgggaggcagatttgtaactcatccaggtcaaaaggctcatatctaaagatagtagaggaacaaaatgtataaggatgtgaactgggaaacaaatacatataaatagtttgtaaatatgaaaagatctttaacctcagtaaataaaaagctatagagagacttattttttaacttagttttttaaacctattatgtttatttattttttctttttttgagacggagtctcgctgttgcccaggctggtgtgcaatggcgcaatctcggctcactgcaacctccgcctcccaggttgaagccattctcctgcctcagcctcctgagtagctgggattacaggcgcctgtcaccacgcccagctaattgttcgcatttttagtagagacggggtttcactatgttggccaggctggcctcgaactcctgacctcatgatccacccaccttggccttccaaagtgctgggattacaggtgtgagctgccgcacctggctgtttatctcttttttttagagaaaggatctcggtcacccaggatggagtgtggtagcctgatcatatctcactacatcttagaacttctaggcttagggtattctcccacctcagcctcccaagtagctgggactacaagtgtgcaccatcacacctagctgatttttacatttttattttggagagatggtgtctccctgtgttgcccaggctggtcacaaactcctaggctcaagcgattctcctgactcaggcatgagccaccgtacccggcctaaacctatcatgttacagacttagaaagcaactattgtcaagtgtttgaggaaactcaggtcaggtttggtaaactaagatattaactcaagtaaagctctttaattcatttaatgaaggtgccacattgtctcagttctctatggcatgggtgaatgctgttctaagtcagcattggtactctaagctagttacatcatatctaagctttgcccttctaccagagctgctagcattctgtcaatgggcaattatttgaagttcttacattgaagttagtcacctacatcttctgttttttatggttttgatgtagtaatactgctgaagtttttttgataactgcgattcataatatttgttattcatattgtgatataaatgataagggcttttgaaaacaagtagtaatcatttcaatagcttaggatctccaccataatcttaggaaaattactaacctctgtgcctcagttgcttcatcatttaaaatgaggaaaataatagtccctacttaataggtttgttgtgaggattgagttaataacatagttaatgctcagtaagggttagctgctatttttttttcttttttttttgaaagagtctcactctgttgcccaggttggagtgcagtggcatgatcttggctcactgcatcctctgcttcctaggttcaggtgattctcatgcttcagcctcccaagcagctgggagtacaggtgtgcaccaccacacctggctaatttttgtatatttagtagagacgggttctcaccatattgtccaggctggtcttgaactccttacctcaaatgatccacccgcctgggcctcccaaagtgctgggattacaagcatgagccaccgcgcctggcttgctattgttatgaggtaaaggtagatagatgggtgagagtggtgccaggggaagtgttaaatttttgagtgttcctttagatgccagatgggttgtatctgagccttttattgcagtttgatgcctactagtgtgaagactactaggtcatagtggatagagaagcaatcttttggagacctgattttagcaaggatacgaataatatttgacaactttggggggatcttgatgcctctgtaatttactcaaggataatctcaagaaaaatggcattaagtagattacagaaaaaatagaactatcatattgttattattggctatttacatgagcaatgcggagaaatgtttaggattacagcatttagaagcttctcaattgctgcatttcctcactgtaccacaagatggcagatactgcatttaaaatttttttttctgtgtgttttctcttatagtcacttggtggccatgtaacaagcagagcaacatgtattaacagattctttttgaatgcaatattggattaaaaactttgaattaaactacaattaagtttactgatttaggttttcctataagaattataacactaatttctaagttttacatctgcaaaacacagtagagtgtatctggtagtcattgactaattgtgactttgctagtcagacaaaatggaactgaatattagagccagaataattttctgttttgactggtggtaagaatcagttagtatacagaatgggaaagaattgaaatttatttctaggaattatagttatagtgaagttaatattcaggggcattgggtgcttgttccacgacttttgtttactgaactaagtacctaacccctttggtctttgaacactgcagagttatgattaggattattaatgaaaaattcttttttagtagaacaaacagttaaggacagaagacaccttgattagattctgttatttgctctttttattaagattgtttttactctaaatgttaaagaaatgtataattatttctaaggtaaaatgagtagcaggattctgaataggagattttttttggccagacccattttgcagccagtggtttgtatttaggagtgagttgaacaaagaagactctaatctgtttttgtgttgtggattttttattctattgataaatcagtagcttccagcttctcttgtatcctctactagtcatcttttttgtttcttcagaaataaacatccagggtcacttccctgcccttgccatatacttactaggatgatgtacaggtaaaacttttaaaggaaagtacggacaggcaattcctaaagtaaaagagagcacattatcaaaactggctgtacttaacaaataccaacaaaaagtcattacacttctggcaacaaataatgtttgatttaaaaagacaagaatttccccttttgctcttattttttaaatatgctatgtccttaagtgagaaatgcacttcaaaaattttcttattctgaagtctagccggaaagtttgaacttgtgttgcctttggctagactaggtgaaattaaggggcttaagagggcactgttgtgtggccctgtggtagataatagccctccaagcatgaggatgggagatctaccattcaccagtatttccaaagttatattcttaaaaaggctagatttctaatttccgtagaatctaggtatgttcttttcaactcagcatctgataagaaagtttgggcaagtaggtgcgaaaaatttactctagataccattttccaggaaaaaatataattcaagtccaacgtattactagctgtcaccttccccaacaatcaaataagcattgttattgtcaaacacatttacttgtatagttcagtgttatatgtaatggacttaggtataattcctgtgctattcccttttgatgccaaacacccttttgtaagctgttttgtttgaaatccaaatttatatgtcttaaagtaaatggcagcattgggctttcttaatgtaatgactcttctgccatcctatttctagagttaggcagaaaattctgtaaatctatcttatttccagtctgtttgtgactatggtgggcaataaatctgatttcccagaaaaacacatctggacccctataggtaaggtaaacaagcctcatcttaaattgtttgtacttccgacctgacctcaaaacaccatcatcatctagagcagcaacaagtaaagaacaatgcactggaaatcacatatatgggtctagcaccagcctttacattacacaactttgctttgggcaagtcatttaaatttctgtgcttcagtttactaaatctatgaaactgactaggtaacagctgacatgcttttccagcactccgtcttttacctgtctgatgtcacaaattgatcattcctttctggccttgagatgcgtatcaacccagatagtcattaacccagatagttggcattcaggataaaatgtttttgcctttcctgtcctgcaagctctttaaagtccaaaatatgcctttatatctttatgtgtaataggtatgaaatctatttcttggttgttgaataggataggcttattagacattctaaagtcaacttttttctcatatttaaacatttacccgtagaaattcagttttttaaagttttaagtcagttgattgtaccaaacattactattaaaaaaaaatcaaagtcagagaccagagtttccctgcatcagcgttcagtcaggagacaggaactatactaatttgaacatgtaaagttaaatataatccttaataataacaggattggaataagggataaaagaaagagaattccttctatatatatgtatacacacacatatatatatatacatgtgtatatatgtgtgtgtatgtatattatataatatacatacacacacacaaagaatgtcagacaaggagcagccaccattctgcttactttcactggattaagagtttcataagggcaagggttttgtttgtcttacactccactggggattaatctccagtgtctagaacagtgcctaacacataaataaagcctcaattattatttgtggaatggaatggaatttgagtgaaatggaatgggaatagaatggactggaatggaaatagaagtgggaaggggaatggaaggggatagaagaggattgaagaggacagaaggagatgggataagatgggatgggataggatcgaatctcaggtccaggagtcagaataactgaatcctattccagttctgccatcaacaagtcctgtgaaatttggaaagtcacttaaccctctggccttgtagaatatctcagtgggcatgtctgatgtttcttcatggttagatataggttgcatgttttgggcaagaatatcacaggaatgatgctgtgttctcagtgcacccagtcaggtaatgcatgatttcaatttctctcattactgatgatgttaactttaatcacttagtgaatgagaacatgagcatcattttgaaagcaaactgcaaagttttgatgtcaacattttagcaattacgtataatttcccccaaggatactggctttgagataatgtaaatatacatgggaaagacaaagctcaaataaaggaaaaagaccca

SEQ ID NO: 1925 - DNA, 2000 bp, Homo sapiens
gttcccggcccggcacagttagaacgagaccctcttcctggcgcagcccccgcggttcctgcgggcgggaatcagggggcccgcccgtcttgtctcctgcctctcccccttcggccgtgcagtccgcagcctcgaaggtggccgccgctggggacggcgccggcctaccccgccttggtggtggcggcggcgaagggggcggcccattctctcccttctcccgcccaccattcgtggcaacgcaggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttgg

SEQ ID NO: 1926 - DNA, 1959 bp, Homo sapiens
agcacgcacggccggggaggggctggcggcggccgcgggcggcgggcggcggaggtgcggggcctgctcccgccggcaccatggccaagaccgtggcctatttctacgaccccgacgtgggcaacttccactacggagctggacaccctatgaagccccatcgcctggcattgacccatagcctggtcctgcattacggtctctataagaagatgatcgtcttcaagccataccaggcctcccaacatgacatgtgccgcttccactccgaggactacattgacttcctgcagagagtcagccccaccaatatgcaaggcttcaccaagagtcttaatgccttcaacgtaggcgatgactgcccagtgtttcccgggctctttgagttctgctcgcgttacacaggcgcatctctgcaaggagcaacccagctgaacaacaagatctgtgatattgccattaactgggctggtggtctgcaccatgccaagaagtttgaggcctctggcttctgctatgtcaacgacattgtgattggcatcctggagctgctcaagtaccaccctcgggtgctctacattgacattgacatccaccatggtgacggggttcaagaagctttctacctcactgaccgggtcatgacggtgtccttccacaaatacggaaattacttcttccctggcacaggtgacatgtatgaagtcggggcagagagtggccgctactactgtctgaacgtgcccctgcgggatggcattgatgaccagagttacaagcaccttttccagccggttatcaaccaggtagtggacttctaccaacccacgtgcattgtgctccagtgtggagctgactctctgggctgtgatcgattgggctgctttaacctcagcatccgagggcatggggaatgcgttgaatatgtcaagagcttcaatatccctctactcgtgctgggtggtggtggttatactgtccgaaatgttgcccgctgctggacatatgagacatcgctgctggtagaagaggccattagtgaggagcttccctatagtgaatacttcgagtactttgccccagacttcacacttcatccagatgtcagcacccgcatcgagaatcagaactcacgccagtatctggaccagatccgccagacaatctttgaaaacctgaagatgctgaaccatgcacctagtgtccagattcatgacgtgcctgcagacctcctgacctatgacaggactgatgaggctgatgcagaggagaggggtcctgaggagaactatagcaggccagaggcacccaatgagttctatgatggagaccatgacaatgacaaggaaagcgatgtggagatttaagagtggcttgggatgctgtgtcccaaggaatttcttttcacctcttggttgggctggagggaaaaggagtggctcctagagtcctgggggtcaccccagggcttttgctgactctgggaaagagtctggagaccacatttggttctcgaaccatctacctgcttttcctctctctcccaaggcctgacaatggtacctattagggatgagatacagacaaggatagctatctgggacattattggcagtgggccctggaggccagtccctagccccccttgccccttatttcttccctgcttccctcgaacccagagatttttgagggatgaacgggtagacaaggactgagattgcctctgacttcctcctcccctgggttctgacttcttcctccccttgcttccagggaagatgaagagagagagatttggaaggggctctggctccctaacacctgaatcccagatgatgggaagtatgttttcaagtgtggggaggatatgaaaatgttctgttctcacttttggctttatgtccattttaccactgtttttatccaataaactaagtcggtattttttgtaccttt

SEQ ID NO: 1927 - DNA, 8976 bp, Homo sapiens
ggaggttgtggggccgccgccgcggagcaccgtccccgccgccgcccgagcccgagcccgagcccgcgcacccgcccgcgccgccgccgccgccgcccgaacagcctcccagcctgggcccccggcggcgccgtggccgcgtcccggctgtcgccgcccgagcccgagcccgcgcgccggcgggtggcggcgcaggctgaggagatgcggcgcggagcgccggagcagggctagagccggccgccgccgcccgccgcggtaagcgcagccccggcccggcgcccgcgggccattgtccgccgcccgccccgcgccccgcgcagcctgcaggccttggagcccgcggcaggtggacgccgccggtccacacccgccccgcgcgcggccgtgggaggcgggggccagcgctggccgcgcgccgtgggacccgccggtccccagggccgcccggccccttctggacctttccacccgcgccgcgaggcggcttcgcccgccggggcgggggcgcgggggtgggcacggcaggcagcggcgccgtctcccggtgcggggcccgcgccccccgagcaggttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccagcacggtggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactgcatttccagcgaccctcgctactggtacgggaaaacgcagcacagttcccttgaccagagttctccaccccagagcggagtgtcgacctcctataaccacccggtcctgggaatgtacgacgccaaagatgacttccctcttaggaaaacagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccgccggcacaagcacccctcgtcacaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtggacagtgacaccatatggaacgaggtgcactcggcgggggcagcccgcctggctgtgggctgcgtggtagagctggtcttcaaggtggccacaggggagctgaagaatggctttgctgtggtccgcccccctggacaccatgcggaggagagcacgcccatgggcttttgctacttcaactccgtggccgtggcagccaagcttctgcagcagaggttgagcgtgagcaagatcctcatcgtggactgggacgtgcaccatggaaacgggacccagcaggctttctacagcgaccccagcgtcctgtacatgtccctccaccgctacgacgatgggaacttcttcccaggcagcggggctcctgatgaggtgggcacagggcccggcgtgggtttcaacgtcaacatggctttcaccggcggcctggacccccccatgggagacgctgagtacttggcggccttcagaacggtggtcatgccgatcgccagcgagtttgccccggatgtggtgctggtgtcatcaggcttcgatgccgtggagggccaccccacccctcttgggggctacaacctctccgccagatgcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagctcagccaagaaactttcccgtgtcacgcctgcgtcccaccgtggggctctcttggagcacccagggacacccagcgtgcaacagccacgggaagcctttctgccgcccaggcccacaggtctcgagacgcacatgcacgcctgggcgtggcagcctcacagggaacacgggacagacgccggcgacgcgcagacacacggacacgcggaagccaagcacactctggcgggtcccgcaagggacgccgtggaagaaaggagcctgtggcaacaggcggccgagctgccgaattcagttgacacgaggcacagaaaacaaatatcaaagatctaataatacaaaacaaacttgattaaaactggtgcttaaagtttattacccacaactccacagtctctgtgtaaaccactcgactcatcttgtagcttatttttttttaaagaggacgttttctacggctgtggcccgcctctgtgaaccatagcggtgtgcggcggggggtctgcacccgggtgggggacagagggacctttaaagaaaacaaaactggacagaaacaggaatgtgagctgggggagctggcttgagtttctcaaaagccatcggaagatgcgagtttgtgcctttttttttattgctctggtggatttttgtggctgggttttctgaagtctgaggaacaatgccttaagaaaaaacaaacagcaggaatcggtgggacagtttcctgtggccagccgagcctggcagtgctggcaccgcgagctggcctgacgcctcaagcacgggcaccagccgtcatctccggggccaggggctgcagcccggcggtccctgttttgctttattgctgtttaagaaaaatggaggtagttccaaaaaagtggcaaatcccgttggaggttttgaagtccaacaaattttaaacgaatccaaagtgttctcacacgtcacatacgattgagcatctccatctggtcgtgaagcatgtggtaggcacacttgcagtgttacgatcggaatgctttttattaaaagcaagtagcatgaagtattgcttaaattttaggtataaataaatatatatatgtataatatatattccaatgtattccaagctaagaaacttacttgattcttatgaaatcttgataaaatatttataatgcatttatagaaaaagtatatatatatatataaaatgaatgcagattgcgaaggtccctgcaaatggatggcttgtgaatttgctctcaaggtgcttatggaaagggatcctgattgattgaaattcatgttttctcaagctccagattggctagatttcagatcgccaacacattcgccactgggcaactaccctacaagtttgtactttcattttaattattttctaacagaaccgctcccgtctccaagccttcatgcacatatgtacctaatgagtttttatagcaaagaatataaatttgctgttgatttttgtatgaattttttcacaaaaagatcctgaataagcattgttttatgaattttacatttttcctcaccatttagcaattttctgaatggtaataatgtctaaatctttttcctttctgaattcttgcttgtacatttttttttacctttcaaaggtttttaattatttttgtttttatttttgtacgatgagttttctgcagcgtacagaattgttgctgtcagattctattttcagaaagtgagaggagggaccgtaggtcttttcggagtgacaccaacgattgtgtctttcctggtctgtcctaggagctgtataaagaagcccaggggctctttttaactttcaacactagtagtattacgaggggtggtgtgtttttcccctccgtggcaagggcagggagggttgcttaggatgcccggccaccctgggaggcttgccagatgccgggggcagtcagcattaatgaaactcatgtttaaacttctctgaccacatcgtcaggatagaattctaacttgagttttccaaagaccttttgagcatgtcagcaatgcatggggcacacgtggggctctttacccacttgggtttttccactgcagccacgtggccagccctggattttggagcctgtggctgcaaggaacccagggacccttgttgcctggtgaacctgcagggagggtatgattgcctgaccaggacagccagtctttactctttttctcttcaacagtaactgacagtcacgttttactggtaacttattttccagcacatgaagccaccagtttcattccaaagtgtatattgggttcagacttgggggcagaagttcagacacaccgtgctcaggagggacccagagccgagtttcggagtttggtaaagtttacagggtagcttctgaaattaactcaaacttttgaccaaatgagtgcagattcttggattcacttggtcactgggctgctgatggtcagctctgagacagtggtttgagagcaggcagaacggtcttgggacttgtttgactttcccctccctggtggccactctttgctctgaagcccagattggcaagaggagctggtccattccccattcatggcacagagcagtggcagggcccagctagcaggctcttctggcctccttggcctcattctctgcatagccctctggggatcctgccacctgccctcttaccccgccgtggcttatggggaggaatgcatcatctcactttttttttttaagcagatgatgggataacatggactgctcagtggccaggttatcagtggggggacttaattctaatctcattcaaatggagacgccctctgcaaaggcctggcagggggaggcacgtttcatctgtcagctcactccagcttcacaaatgtgctgagagcattactgtgtagccttttctttgaagacacactcggctcttctccacagcaagcgtccagggcagatggcagaggatctgcctcggcgtctgcaggcgggaccacgtcagggagggttccttcatgtgttctccctgtgggtccttggacctttagcctttttcttcctttgcaaaggccttgggggcactggctgggagtcagcaagcgagcactttatatccctttgagggaaaccctgatgacgccactgggcctcttggcgtctgccctgccctcgcggcttcccgccgtgccgcagcgtgcccacgtgcccacgccccaccagcaggcggctgtcccggaggccgtggcccgctgggactggccgcccctccccagcgtcccagggctctggttctggagggccactttgtcaaggtgtttcagtttttctttacttcttttgaaaatctgtttgcaaggggaaggaccatttcgtaatggtctgacacaaaagcaagtttgatttttgcagcactagcaatggactttgttgtttttctttttgatcagaacattccttctttactggtcacagccacgtgctcattccattcttctttttgtagactttgggcccacgtgttttatgggcattgatacatatataaatatatagatataaatatatatgaatatatttttttaagtttcctacacctggaggttgcatggactgtacgaccggcatgactttatattgtatacagattttgcacgccaaactcggcagctttggggaagaagaaaaatgcctttctgttcccctctcatgacatttgcagatacaaaagatggaaatttttctgtaaaacaaaaccttgaaggagaggagggcggggaagtttgcgtcttattgaacttattcttaagaaattgtactttttattgtaagaaaaataaaaaggactacttaaacatttgtcatattaagaaaaaaagtttatctagcacttgtgacataccaataatagagtttattgtatttatgtggaaacagtgttttagggaaactactcagaattcacagtgaactgcctgtctctctcgagttgatttggaggaattttgttttgttttgttttgtttgtttccttttatctccttccacgggccaggcgagcgccgcccgccctcactggccttgtgacggtttattctgattgagaactgggcggactcgaaagagtccccttttccgcacagctgtgttgactttttaattacttttaggtgatgtatggctaagatttcactttaagcagtcgtgaactgtgcgagcactgtggtttacaattatactttgcatcgaaaggaaaccatttcttcattgtaacgaagctgagcgtgttcttagctcggcctcactttgtctctggcattgattaaaagtctgctattgaaagaaaaagaaagcgaacagtttttgtttgttttttttgccgtgtgtgctccatagtggaggcgctattttccaattgatgagaatgacaaacatatataatctatctatctatctatctatctatctatctatacagggggcttgaaccttactcacccaagagcttcttacggaatgtggtagaaaaccaagttgtaacgacactgtaacctacctgatgcctgttcgcgcccgccgtgagctgcgcactggccgtggccaccattcacctctgtaatttaatccgtttctcttggattgtctggacgtgcccgatggttctttcttttgctcagtggagttggaggttttgtgtttggttttctcattcttgtcttgttttgtgtgggtggattttcaccgaccaatgatatcctcttctgacggtcaccttctttccacttcactggagtccagtattctgtaccacatcacgcaacgtgttatcttgtggtgtaaataaagactgcgttacttgccctccca

SEQ ID NO: 1928 - DNA, 2631 bp, Homo sapiens
aaagtcctgtttttcgaagcctgaatttggtattccagtgacgcacctgccctccagaagccaactgagggttcccatggagaataagtacctattcacgatgctaggatgtggggcaggagtgaagaagagtgaaatggccatcttcccttgtggttccagcattttccgagcatgccgagggcagagggtccctgtgtcttctttgaagatcaagaaacaggcctgacgtctcagcttgtgctatgaacagggagtgttgaaatccagtttgtcctgatggctttcactttgcaggctttgctctacagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactgcatttccagcgaccctcgctactggtacgggaaaacgcagcacagttcccttgaccagagttctccaccccagagcggagtgtcgacctcctataaccacccggtcctgggaatgtacgacgccaaagatgacttccctcttaggaaaacagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccgccggcacaagcacccctcgtcacaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtaagtgttcctttaatgtgtaaataatgtcctgtttcttctcgagtcccagtggtcacagaaatcgcagccttgcttccctcaaagtgaataattgctgccaggtgttttccatacgcaggggctgcccatgtgcggcttcaaaggccgtgtgagccgagagcgttttgatcgccgactcgggcacctttctctggggaaggttgtctggcgcaggtggctggggctctggggtgcagtggctctcgctttaagaaacaggatcctgtatgcagccagcatctcatccccttcgaagtctgtggcagtaatctgctcacatcaggccacgagtatggtgcgggtaggatgcgtgcttctgtattctgtacctagtttccacccgaagctacag

SEQ ID NO: 1929 - DNA, 3745 bp, Homo sapiens
ccgcctggctcgacgctggagtggggagaagcatcatggttcaacgttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactgcatttccagcgaccctcgctactggtacgggaaaacgcagcacagttcccttgaccagagttctccaccccagagcggagtgtcgacctcctataaccacccggtcctgggaatgtacgacgccaaagatgacttccctcttaggaaaacagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccgccggcacaagcacccctcgtcacagactggtatctttcaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtggacagtgacaccatatggaacgaggtgcactcggcgggggcagcccgcctggctgtgggctgcgtggtagagctggtcttcaaggtggccacaggggagctgaagaatggctttgctgtggtccgcccccctggacaccatgcggaggagagcacgcccatgggcttttgctacttcaactccgtggccgtggcagccaagcttctgcagcagaggttgagcgtgagcaagatcctcatcgtggactgggacgtgcaccatggaaacgggacccagcaggctttctacagcgaccccagcgtcctgtacatgtccctccaccgctacgacgatgggaacttcttcccaggcagcggggctcctgatgaggtgggcacagggcccggcgtgggtttcaacgtcaacatggctttcaccggcggcctggacccccccatgggagacgctgagtacttggcggccttcagaacggtggtcatgccgatcgccagcgagtttgccccggatgtggtgctggtgtcatcaggcttcgatgccgtggagggccaccccacccctcttgggggctacaacctctccgccagatgcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagctcagccaagaaactttcccgtgtcacgcctgcgtcccaccgtggggctctcttggagcacccagggacacccagcgtgcaacagccacgggaagcctttctgccgcccaggcccacaggtctcgagacgcacatgcacgcctgggcgtggcagcctcacagggaacacgggacagacgccggcgacgcgcagacacacggacacgcggaagccaagcacactctggcgggtcccgcaagggacgccgtggaagaaaggagcctgtggcaacaggcggccgagctgccgaattcagttgacacgaggcacagaaaacaaatatcaaagatctaataatacaaaacaaacttgattaaaactggtgcttaaagtttattaccc

SEQ ID NO: 1930 - DNA, 2775 bp, Homo sapiens
agttttcggcagagtcgcgtgtctgagaagtgacgctgggatgtccctgggctgtgccaggagcagtgctggctcagatggatgtggccacggcgctgcctctgcaagtggccccctcggcagtgcccatggacctgcgcctggaccaccagttctcactgcctgtggcagagccggccctgcgggagcagcagctgcagcaggagctcctggcgctcaagcagaagcagcagatccagaggcagatcctcatcgctgagttccagaggcagcacgagcagctctcccggcagcacgaggcgcagctccacgagcacatcaagcaacaacaggagatgctggccatgaagcaccagcaggagctgctggaacaccagcggaagctggagaggcaccgccaggagcaggagctggagaagcagcaccgggagcagaagctgcagcagctcaagaacaaggagaagggcaaagagagtgccgtggccagcacagaagtgaagatgaagttacaagaatttgtcctcaataaaaagaaggcgctggcccaccggaatctgaaccactgcatttccagcgaccctcgctactggtacgggaaaacgcagcacagttcccttgaccagagttctccaccccagagcggagtgtcgacctcctataaccacccggtcctgggaatgtacgacgccaaagatgacttccctcttaggaaaacagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccgccggcacaagcacccctcgtcacagactggtatctttcaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtaagtgttcctttaatgtgtaaataatgtcctgtttcttctcgagtcccagtggtcacagaaatcgcagccttgcttccctcaaagtgaataattgctgccaggtgttttccatacgcaggggctgcccatgtgcggcttcaaaggccgtgtgagccgagagcgttttgatcgccgactcgggcacctttctctggggaaggttgtctggcgcaggtggctggggctctggggtgcagtggctctcgctttaagaaacaggatcctgtatgcagccagcatctcatccccttcgaagtctgtggcagtaatctgctcacatcaggccacgagtatggtgcgggtaggatgcgtgcttctgtattctgtacctagtttccacccgaagctacaggtggggctcccagtgcagtgaccgtgatactcatgggccacgtggagtctgtagggctactcgctgggctgtgctggcttctgtgagctgatgatatggacctggcctgggcatatg

SEQ ID NO: 1931 - DNA, 2707 bp, Homo sapiens
atatcaggccagctgtgaccctagaggagtaggccatatcagccagccacatccctggagccgtgggctgtattggtccagctgtgaccctagagcttctgaaccgaatctgaaattacggtccaggctaaagcagaaagtggccgaaagacggagcagccccctgttacgcaggaaagacgggccagtggtcactgctctaaaaaagcgtccgttggatgtcacagactccgcgtgcagcagcgccccaggctccggacccagctcacccaacaacagctccgggagcgtcagcgcggagaacggtatcgcgcccgccgtccccagcatcccggcggagacgagtttggcgcacagacttgtggcacgagaaggctcggccgctccacttcccctctacacatcgccatccttgcccaacatcacgctgggcctgcctgccaccggcccctctgcgggcacggcgggccagcaggacgccgagagactcacccttcccgccctccagcagaggctctcccttttccccggcacccacctcactccctacctgagcacctcgcccttggagcgggacggaggggcagcgcacagccctcttctgcagcacatggtcttactggagcagccgccggcacaagcacccctcgtcacaggcctgggagcactgcccctccacgcacagtccttggttggtgcagaccgggtgtccccctccatccacaagctgcggcagcaccgcccactggggcggacccagtcggccccgctgccccagaacgcccaggctctgcagcacctggtcatccagcagcagcatcagcagtttctggagaaacacaagcagcagttccagcagcagcaactgcagatgaacaagatcatccccaagccaagcgagccagcccggcagccggagagccacccggaggagacggaggaggagctccgtgagcaccaggctctgctggacgagccctacctggaccggctgccggggcagaaggaggcgcacgcacaggccggcgtgcaggtgaagcaggagcccattgagagcgatgaggaagaggcagagcccccacgggaggtggagccgggccagcgccagcccagtgagcaggagctgctcttcagacagcaagccctcctgctggagcagcagcggatccaccagctgaggaactaccaggcgtccatggaggccgccggcatccccgtgtccttcggcggccacaggcctctgtcccgggcgcagtcctcacccgcgtctgccaccttccccgtgtctgtgcaggagccccccaccaagccgaggttcacgacaggcctcgtgtatgacacgctgatgctgaagcaccagtgcacctgcgggagtagcagcagccaccccgagcacgccgggaggatccagagcatctggtcccgcctgcaggagacgggcctccggggcaaatgcgagtgcatccgcggacgcaaggccaccctggaggagctacagacggtgcactcggaagcccacaccctcctgtatggcacgaaccccctcaaccggcagaaactggacagtaagaaacttctaggctcgctcgcctccgtgttcgtccggctcccttgcggtggtgttggggtggacagtgacaccatatggaacgaggtgcactcggcgggggcagcccgcctggctgtgggctgcgtggtagagctggtcttcaaggtggccacaggggagctgaagaatggctttgctgtggtccgcccccctggacaccatgcggaggagagcacgcccatgggcttttgctacttcaactccgtggccgtggcagccaagcttctgcagcagaggttgagcgtgagcaagatcctcatcgtggactgggacgtgcaccatggaaacgggacccagcaggctttctacagcgaccccagcgtcctgtacatgtccctccaccgctacgacgatgggaacttcttcccaggcagcggggctcctgatgaggtgggcacagggcccggcgtgggtttcaacgtcaacatggctttcaccggcggcctggacccccccatgggagacgctgagtacttggcggccttcagaacggtggtcatgccgatcgccagcgagtttgccccggatgtggtgctggtgtcatcaggcttcgatgccgtggagggccaccccacccctcttgggggctacaacctctccgccagatgcttcgggtacctgacgaagcagctgatgggcctggctggcggccggattgtcctggccctcgagggaggccacgacctgaccgccatttgcgacgcctcggaagcatgtgtttctgccttgctgggaaacgagcttgatcctctcccagaaaaggttttacagcaaagacccaatgcaaacgctgtccgttccatggagaaagtcatggagatccacagcaagtactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagagaccagatgaggagcccatggaagaggagccgcccctgtagcactccctcgaagctgctgttctcttgtctgtctgtctctgtcttgaagctcagccaagaaactttcccgtgtcacgcctgcgtcccacc

SEQ ID NO: 1932 - DNA, 342 bp, Homo sapiens
gacgctggagtggggagaagcatcatggttcaacgttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccagatggactttctggccgagaccagccagtggagctgctgaatcctgcccgcgtgaaccacatgcccag

SEQ ID NO: 1933 - DNA, 4190 bp, Homo sapiens
gaaggcggctagggactggctgaagagggttagcgaaacgttagcggtcgggtctgggcagggggtggagctggttgaaggaacggggcagtcccctgaggagcggggctggttgaaacgctaggggcgggatctggcggagtggaagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 1934 - DNA, 736 bp, Homo sapiens
gtacagcgcgtcgacggcggaggcgggaagggggcggaggccgaccgaaggcggctagggactggctgaagaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattag

SEQ ID NO: 1935 - DNA, 4179 bp, Homo sapiens
gttagcggtcgggtctgggcagggggtggagctggttgaaggaacggggcagtcccctgaggagcggggctggttgaaacgctaggggcgggatctggcggagtggaaggtaccggtccggcccgataaggggtggaaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgttaaaaaa

SEQ ID NO: 1936 - DNA, 907 bp, Homo sapiens
agctggcgtagcacgccgacgcaccgccccgccgcttgtgagctcgcgagaggtgtggctcgcgcgaggggcgcggccttgaggcacggtcccctctggaggcgggatctgggcgggcagtcgagagacgaggcccaatggaaaagaaaagcctgagcgctcgcgtccccacaggtcgccagaaacttggtggagcgagccaagggcggagtttgagaaaggggctgcgtccaatgagtggagcgaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattag

SEQ ID NO: 1937 - DNA, 1130 bp, Homo sapiens
ggggtggagttaagtgaatcgttaagggtggagtcgaaaccggggtcggggccggggccggctgagtgaaagggtgggtgattatcccgggagataggccgaaagggcagaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgaggtcctggggatctggggtgtgttgggaggaggagtggccttgaaggttaggctgtgagggtaggtagcctcatggagtctgttcccccttcagttccagcctcagctggtcctg

SEQ ID NO: 1938 - DNA, 583 bp, Homo sapiens
agcccgcccgcgctacgtcatcacggcgcgtcgcgcgggaagtcgcggggaaaaggtcgccagaaacttggtggagcgagccaagggcggagtttgagaaaggggctgcgtccaatgagtggagcgaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgt

SEQ ID NO: 1939 - DNA, 882 bp, Homo sapiens
ggagtcgaaaccggggtcggggccggggccggctgagtgaaaggaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccaggt

SEQ ID NO: 1940 - DNA, 2544 bp, Homo sapiens
gggcagtcccctgaggagcggggctggttgaaacgctaggggcgggatctggcggagtggaagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcaccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctg

SEQ ID NO: 1941 - DNA, 610 bp, Homo sapiens
atcacggcgcgtcgcgcgggaagtcgcggggaaaaggtaagatgccccttcctaattccctcgcttccttgcttgctctccagacaccgccgacccgaagggctcctaagtgactggacagggacggaggggcggcggctatggcatccgggacgacagcgacgatagccgaggcaagaaaaagcttgcaccgcagccctgtcgggaaccgccggcgcctgccttttacgtaggcgcagcacagctggcgtagcacgccgacgcaccgccccgtcgcctgtgagctcgcggtgtggctcagcccagctggcgtagcacgccgacgcaccgccccgccgcttgtgagctcgcgagaggtcgccagaaacttggtggagcgagccaagggcggagtttgagaaaggggctgcgtccaatgagtggagcgaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaag

SEQ ID NO: 1942 - DNA, 658 bp, Homo sapiens
gcgtaaggaatggaatctaatagagggggcggagcctggaaaagggcagagaggtggggtcctcagggcacactagccccctcacatacccacgctcctccccccacccccagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacga

SEQ ID NO: 1943 - DNA, 599 bp, Homo sapiens
agggtggagtcgaaaccggggtcggggccggggccggctgagtgaaagggtgggtgattatcccgggagataggccgaaagggcagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgag

SEQ ID NO: 1944 - DNA, 568 bp, Homo sapiens
gaggcggagtttggaaggctgtggagaatcagatcgcaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtccta

SEQ ID NO: 1945 - DNA, 3887 bp, Homo sapiens
agaaacttggtggagcgagccaagggcggagtttgagaaaggggctgcgtccaatgagtggagcgaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctatccccaatctagcggaggtaaagaagaaaggcaaaatgaagaagctcggccaagcaatggaagaagacctaatcgtgggactgcaagggatggatctgaaccttgaggctgaagcactggctggcactggcttggtgttggatgagcagttaaatgaattccattgcctctgggatgacagcttcccggaaggccctgagcggctccatgccatcaaggagcaactgatccaggagggcctcctagatcgctgcgtgtcctttcaggcccggtttgctgaaaaggaagagctgatgttggttcacagcctagaatatattgatctgatggaaacaacccagtacatgaatgagggagaactccgtgtcctagcagacacctacgactcagtttatctgcatccgaactcatactcctgtgcctgcctggcctcaggctctgtcctcaggctggtggatgcggtcctgggggctgagatccggaatggcatggccatcattaggcctcctggacatcacgcccagcacagtcttatggatggctattgcatgttcaaccacgtggctgtggcagcccgctatgctcaacagaaacaccgcatccggagggtccttatcgtagattgggatgtgcaccacggtcaaggaacacagttcaccttcgaccaggaccccagtgtcctctatttctccatccaccgctacgagcagggtaggttctggccccacctgaaggcctctaactggtccaccacaggtttcggccaaggccaaggatataccatcaatgtgccttggaaccaggtggggatgcgggatgctgactacattgctgctttcctgcacgtcctgctgccagtcgccctcgagttccagcctcagctggtcctggtggctgctggatttgatgccctgcaaggggaccccaagggtgagatggccgccactccggcagggttcgcccagctaacccacctgctcatgggtctggcaggaggcaagctgatcctgtctctggagggtggctacaacctccgcgccctggctgaaggcgtcagtgcttcgctccacacccttctgggagacccttgccccatgctggagtcacctggtgccccctgccggagtgcccaggcttcagtttcctgtgctctggaagcccttgagcccttctgggaggttcttgtgagatcaactgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacagccaccaccctgaggtaccccagcgcatcttgcggatcatgtgccgtctggaggagctgggccttgccgggcgctgcctcaccctgacaccgcgccctgccacagaggctgagctgctcacctgtcacagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggttctgaatggtgctgctgtggtgcgtcccccaggacaccacgcagagcaggatgcagcttgcggtttttgctttttcaactctgtggctgtggctgctcgccatgcccagactatcagtgggcatgccctacggatcctgattgtggattgggatgtccaccacggtaatggaactcagcacatgtttgaggatgaccccagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgagtttaacccagaactggtgctggtctcagctggctttgatgctgcacggggggatccgctggggggctgccaggtgtcacctgagggttatgcccacctcacccacctgctgatgggccttgccagtggccgcattatccttatcctagagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgaaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcagggggcctcagaatctcaggccccaggagaggagaacctactaggagaggcagctggaggtcaggacatggctgattcgatgctgatgcagggatctaggggcctcactgatcaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtctactgtggtcgttacatcaatggccacatgctccaacaccatggaaattctggacacccgctggtcctcagctacatcgacctgtcagcctggtgttactactgtcaggcctatgtccaccaccaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttattt

SEQ ID NO: 1946 - DNA, 4095 bp, Homo sapiens
atgcacagccccggcgctgatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagcctcaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccactgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctccccaagaagcgcagcatacccctgggacccctcggccactgcccactcggggagccttctctgtttctggggcctcccccaccatagctctgattcccaccccacataggagtagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgctttaaaa

SEQ ID NO: 1947 - DNA, 4065 bp, Homo sapiens
ggcgactggggggatgtgaggccggcgccccagccccccgccccgccatgagccccccgctctgagggccccggcccctggatgcacagccccggcgctgatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagcctcaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccactgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctccccaagaagcgcagcatacccctgggacccctcggccactgcccactcggggagccttctctgtttctggggcctcccccaccatagctctgattcccaccccacataggagtagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgctttaaaa

SEQ ID NO: 1948 - DNA, 3261 bp, Homo sapiens
atttagaatgagtgacttgaggaagagggagctgggagcccttttcaccagcagggggactggaggagtcgaatgggatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacatgggtgccctcacactgagccagattccaggacatggttcctcacagcagcaggcaggaggagcattctcctggcctgggcacccatgcagagcggccgtggtgatggtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagag

SEQ ID NO: 1949 - DNA, 576 bp, Homo sapiens
attgtcatcctacccggccggccgggctgccagggccctccccctcccggccccctcccttcctctcgccgtctcacagtcgctctgcagcctccggcgactggggggatgtgaggccggcgccccagccccccgccccgccatgagccccccgctctgagggccccggcccctggatgcacagccccggcgctggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggca

SEQ ID NO: 1950 - DNA, 3016 bp, Homo sapiens
acaccctttttcttttaataggaacaggctggacccttccgttcccctcagcaggcatgatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaa

SEQ ID NO: 1951 - DNA, 3216 bp, Homo sapiens
acagtcgctctgcagcctccggcgactggggggatgtgaggccggcgccccagccccccgccccgccatgagccccccgctctgagggccccggcccctggatgcacagccccggcgctggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactgg

SEQ ID NO: 1952 - DNA, 1161 bp, Homo sapiens
aaatggccccgtagggcaacaaggatggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggcaagagtgacgtgtctgatgttggcctagggaagggacggtactacagtgtaaatgtgcccattcaggatggcatacaagatgaaaaatattaccagatctgtgaaagtgtacgaacctcctgccccaaatccaggcctgtagaagcagctgccgcagcttgtcttccccatttgcatagccttgtctga

SEQ ID NO: 1953 - DNA, 2014 bp, Homo sapiens
aaatggccccgtagggcaacaaggatggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgacaggcagggtttgggcctcaggaccatccaggtggagccctgggagagagggtactgatcagcagactgggaggtggggagaagtccgctggtgttgttttagtgttatatatctttggtttttttaataaaatctttgaaaaccta

SEQ ID NO: 1954 - DNA, 1740 bp, Homo sapiens
aaatggccccgtagggcaacaaggatggttagttttgaccctacttatttgtgccataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttatttaaaaaaacacacacacacaaatgaaatttttaatctttgaaaattatttttaagcgaattggggaggggagtattttaatcatcttaaatgaaacagatcagaagctggatgagagcagtcaccagtttgtagggcaggaggcagctgacaggcagggtttgggcctcaggaccatccaggtggagccctgggagagagggtactgatcagcagactgggaggtggggagaagtccgctggtgttgttttagtgttatatatctttggtttttttaataaaatctttgaaaacct

SEQ ID NO: 1955 - DNA, 1316 bp, Homo sapiens
agaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctagagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaagtgtactaaaggaagtataccaagcctttaatcccaaagcagtggtcttacagctgggagctgacacaatagctggggatcccatgtgctcctttaacatgactccagtgggaattggcaagtgtcttaagtacatccttcaatggcagttggcaacactcattttgggaggaggaggctataaccttgccaacacggctcgatgctggacatacttgaccggggtcatcctagggaaaacactatcctctgagatcccagatcatgagtttttcacagcatatggtcctgattatgtgctggaaatcacgccaagctgccggccagaccgcaatgagccccaccgaatccaacaaatcctcaactacatcaaagggaatctgaagcatgtggtctagttgacagaaagagatcaggtttccagagctgaggagtggtgcctataatgaagacagcgtgtttatgcaagcagtttgtggaatttgtgactgcagggaaaatttgaaagaaattacttcctgaaaatttccaaggggcatcaagtggcagctggcttcctggggtgaagaggcaggcaccccagagtcctcaactggacctaggggaagaaggagatatcccacatttaaagttcttattt

SEQ ID NO: 1956 - DNA, 833 bp, Homo sapiens
gcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaagtaagaaaatgacctttctgttttctgactctttccttgagtcagtttctcagttatgtaaactcttatgcttattgtattgacatttacagagagacgtgtgtgtatgtggcactttacaaggcattctgaagaaatccaagtgaaatagaaaaaagattacctaatatagtggaaagcacactgctcaaagtcaggacacctgggctctacacctagtttttctaacttggctaactgacttggactgattaccctccctaggcctcagtttcttcatcaataaaatgaacaaaggatacaa

SEQ ID NO: 1957 - DNA, 704 bp, Homo sapiens
tccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagagacgtgtgtgtatgtggcactttacaaggcattctgaagaaatccaagtgaaatagaaaaaagattacctaatatagtggaaagcacactgctcaaagtcaggacacctgggctctacacctagtttttctaacttggctaactgacttggactgattaccctccctaggcctcagtttcttcatcaataaaatgaacaaaggatacaacta

SEQ ID NO: 1958 - DNA, 632 bp, Homo sapiens
ccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgagagatgaagcatctggtttttgttatctcaatgatgctgtcctgggaatattacgattgcgacggaaatttgagcgtattctctacgtggatttggatctgcaccatggagatggaacaggtgacgtgtctgatgttggcctagggaagggacggtactacagtgtaaatgtgcccattcaggatggcatacaagatgaaaaatattaccagatctgtgaaaggtacgaacctcctgccccaaatccaggcctgtagaagcagctgccgcagcttgtcttccccatttgcatagccttgtctgaaaactagactgctgaatactgaaggatcaggtttctcatcaagaaaactgcattttaaatgaatatcttgtatgtttatagggaagttactaatgtagtataaagagatgcctg

SEQ ID NO: 1959 - DNA, 2338 bp, Homo sapiens
ataaaaacaatcgatcctaattgacagctatttggacttttacatctgccaaacccttttccttgaactgtggtcactaaatgaggggagtctggtctgggaagtcccatccattccttcaataggatggggagcggtgatagtgtctccggcgatctcaagaataggagggaatgttgaccagggagcaccgctgcggccgatcagaggagcaggaactggaaccctggccgagtccgaaaaaagccagatctggaaggtggctgcggaacggttttaagcggaagatggaggagccggaggaaccggcggacagtgggcagtcgctggtcccggtttatatctatagtcccgagtatgtcagtatgtgtgactccctggccaagatccccaaacgggccagtatggtgcattctttgattgaagcatatgcactgcataagcagatgaggatagttaagcctaaagtggcctccatggaggagatggccaccttccacactgatgcttatctgcagcatctccagaaggtcagccaagagggcgatgatgatcatccggactccatagaatatgggctaggttatgactgcccagccactgaagggatatttgactatgcagcagctataggaggggctacgatcacagctgcccaatgcctgattgacggaatgtgcaaagtagcaattaactggtctggagggtggcatcatgcaaagaaagatgaagcatctggtttttgttatctcaatgatgctgtcctgggaatattacgattgcgacggaaatttgagcgtattctctacgtggatttggatctgcaccatggagatggtgtagaagacgcattcagtttcacctccaaagtcatgaccgtgtccctgcacaaattctccccaggatttttcccaggaacaggtgacgtgtctgatgttggcctagggaagggacggtactacagtgtaaatgtgcccattcaggatggcatacaagatgaaaaatattaccagatctgtgaaaggtacgaacctcctgccccaaatccaggcctgtagaagcagctgccgcagcttgtcttccccatttgcatagccttgtctgaaaactagactgctgaatactgaaggatcaggtttctcatcaagaaaactgcattttaaatgaatatcttgtatgtttatagggaagttactaatgtagtataaagagatgcctgtcctccccctcctttctggataagagattttatactttcacaaaacgaaaaattaatgatttgcagtgtagcaaacagtactgttacagtggttagggaaactttcccaaaagcaatctggagtgacatttcattcatgtattcatttaatgactatttattgaatgcctactatgtataaagtattgattctaccctcgaggaagttagtggaaatttttaaatgttagataaataaatagagattgattttcatattcacacacatttaaataaataaaacatagaaaattgtaagaaccataagagatagaatgctgtgggtattcaaagagagaaaatacttcagaaaaaggcgtaattgaggaggtaacatttgatctggtttctaaagggtagctaattactctatctttacaaagtgtgtgaatgtatatgagtgtttataaaatctgggtcaagtttgaatatacagagattgtagggaaggatgttctacacacagggtacagcaagatcaaagttgggagagactgagctatgtacaaagaatagcagtggttttagtttggctggactgtaaagtgcatggaggagaagttgcaaagaagattggaaacctgggtgggaaccacatcacggaagagctggaattcttagctatgaaaatttgtaccatattctgtaaacattttgggagccactgaaggttttagaatgagggaatcataagatcaaagcttgcttgggaagattaacactcttcccagtaaagttttggcaacagcatctgctgttatattgacataatgtgggtaaagtggctgacatagtatctgatgcataggagctcagtaagtcatggaagcagatatactgtagtggtttagagcaaaaactctggtgcctggatgcctgggttcaaaaaccagctctgccacttaatagctgtgtgattttgtacagatttcttaacctctctgtatggcagtttccccatctgtaaaataggattaaaaataatacctgttatgaattattatgagggtcaaatgagttaagacatgtaaaatacatagaacagtgctctattctgaataaagttctcaataaatgtta

SEQ ID NO: 1960 - DNA, 1477 bp, Homo sapiens
aagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaatggacaactcc

SEQ ID NO: 1961 - DNA, 886 bp, Homo sapiens
gcgaggccacccggaagaccaagccggcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatca

SEQ ID NO: 1962 - DNA, 967 bp, Homo sapiens
gaggccacccggaagaccaagccgggtaggcgctgtctccgtcgcctccaacccccccggtccgaccagggaagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagag

SEQ ID NO: 1963 - DNA, 1748 bp, Homo sapiens
aggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgtggcacctgggcgcaccctccagctcgggccccttccgatgggtctgctggctcaggtgcgggcgatggccggggagccgcgccccgcacgtgactcagcactttccccagagcccggactgcggagaacaatatcctcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggagggatttgttcgtgttgaccgagattatgtgctgaagtctgcagagctggcaaaagctggagggtgcaaacatttcaacttgctatcctctaaaggagctgataaatcaagcaattttttatatctacaagttaagggagaagtagaagccaaggttgaagaattaaaatttgatcgttactctgtatttaggcctggagttctgttatgtgataggcaagaatctcgcccaggtgaatggctggttagaaagttctttggctccttaccagactcttgggccagtgggcattctgtgcctgtggtgaccgtggttagagcaatgctgaacaatgtggtgagaccaagagacaagcagatggaactgctggagaacaaggccatccatgacctggggaaagcgcatggctctctcaagccatgaccacattggagaaatggtttttattgtcaaccttaacacccatcaccaaatcggtaatttcagggtctaaaaaaagtcagcatgttttaactttgttgttttactatcctcaggcatccattccaatcaagaaatgatggtgctctgcatcagtggttcagagcctggttatacatatagatcactcagggagctttggaaaaataaagatttgtcagccctatctcaaacttgaatcaaaatttctggggtgtgggcacaataatctgtaattttctttgtttatacttcccctgatgccactggttccgatgccactggctggggggcctgctttgaaatgcttgtctgcagagtcacagcagccatgaaaaccttatgaccgtgcaaatgagctctgctctaaaattgttgacattcatgtctctgagttacaaaagtgctaattcactacatgtaattgtgtaagtaaacattgtgcctttactacttctttatgtaatagaagttatatacctaagcttatataatacatggggaggattaaataaaggaataaagatgaatggacaactcct

SEQ ID NO: 1964 - DNA, 713 bp, Homo sapiens
aggtcccgcccctgtgggcggggcgaggcagcgtcgccgcgaggccacccggaagaccaagccggcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggtaaggaaggcatatgctcttttccctttttgctggccagtaatatcaaggattcttttcttgctcactctttttctttgtgcctgttgcaatgcttaaatgtgaataagcctttattgtttaagattctatatgctgcactaacctttggtatccttttaatagtactgataagttcgtctttcaaagtaatccttgagttcaggccccagtgctggagacgtcgtaaatatttacatgattttgcctattgtgattatcgctatcactacatcccctgactaagggaaaccatgatgtctgagtaaaactaattggtttatgctgttaacaatcagctgttt

SEQ ID NO: 1965 - DNA, 774 bp, Homo sapiens
tcctccctaacagataaacagcccttgttcctcgggataaggactggcagtcccctgacaccctaagaccggcatctgtcgatgttatttccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggtaaggaaggcatatgctcttttccctttttgctggccagtaatatcaaggattcttttcttgctcactctttttctttgtgcctgttgcaatgcttaaatgtgaataagcctttattgtttaagattctatatgctgcactaacctttggtatccttttaatagtactgataagttcgtctttcaaagtaatccttgagttcaggccccagtgctggagacgtcgtaaatatttacatgattttgcctattgtgattatcgctatcactacatcccctgactaagggaaaccatgatgtctgagtaaaactaattggtttatgctgttaacaatcagctgtttttccccttaataaatgtttgaaatttgaaa

SEQ ID NO: 1966 - DNA, 595 bp, Homo sapiens
ctggcggccgccctgctcctgctgcgtcgtgaggacccggggccgggggctggccccagcatggccgaaacagaagccctgtcgaagcttcgggaagacttcaggatgcagaataaatccgtctttattttgggcgccagcggagaaaccggcagagtgctcttaaaggaaatcctggagcagggcctgttttccaaagtcacgctcattggccggaggaagctcaccttcgacgaggaagcttataaaaatgtgaatcaagaagtggtggactttgaaaagttggatgactacgcctctgcctttcaaggtcatgatgttggattctgttgcctgggtaccaccagagggaaagctggggcggtaaggaaggcatatgctcttttccctttttgctggccagtaatatcaaggattcttttcttgctcactctttttctttgtgcctgttgcaatgcttaaatgtgaataagcctttattgtttaagattctatatgctgcactaacctttggtatccttttaatagtactgataagttcgtctttcaaagtaatccttgagttcaggccccagtgctggagacgtcgtaaata

SEQ ID NO: 1967 - DNA, 2977 bp, Homo sapiens
gagtacaatggaccctggcaaagccccgctcccggcccaggtcttctgctctccaggtctgcccctccggctctccctctctccgggtttccccctccccaccatcatttgcatccagccgaaagctgggcccttcccactaatttgcatatcttatatggcctaatggtggcgatcatggcaagttagaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtgatgcccacacaccacttacttcgtgcgcaacaacaaggaccctgttttccacaccatcaccctctgggcagctgtcatggaaaagcccagtgacctgaccggcacctgcgagaggtccctgcttacctgacggacgtcctgctggcacctcagacaatccactctcaggaggcgcagcccgaagcccagtttcccttctatgcagtattgccacaatgcctctcccacgatgtcaaggactcctgtctgtcctggaggtgggagacaaggaaccaccgaagaggaagcaagaaagccgtactgtctatgttgtgatccttcatcgaacaaactgatgcgaaaacttgaatctgttactgaaatgaggagagaaggacatgtgctattgaactgagccaaacacactgtaaatatccacagactccctcccctgcccccatcccacatgatcttgagatttcttttaaagaagtaaatttgtccaatggctgtaaactataaactactgtaattaagtgcaatttcccctctgtgtcctctcccctctgccctgtatataatactaaagtgtctattagttttctttgtaaaggtcagagtcaaaatttcaaaagtgatctgtcccctctcccctcatggagaaacatcctaagtgggaagtgaagccccttgtcctctcccgcgggcctggacacttatggggacagcataccttggactgactaccagctaactccagtctcctgacattaagacacacctctggatccctggaggggctgaatgtagtgtgtcagagtaacatgccagcttcctgtgggccaggagctcagccgtgcactccctaagaaaccccagggcagggaaactggctgtttgatagcagaagaaaaagttgcagtctcagaaagccttccattaaaacaatttattttatcacta

SEQ ID NO: 1968 - DNA, 1546 bp, Homo sapiens
ggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaatgtcctctacaagcctggtgatgcccacacaccacttacttcgtgcgcaacaacaaggaccctgttttccacaccatcaccctctgggcagctgtcatggaaaagcccagtgacctgaccggcacctgcgagaggtccctgcttacctgac

SEQ ID NO: 1969 - DNA, 1794 bp, Homo sapiens
agaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtgatgcccacacaccacttacttcgtgcgcaacaacaaggaccctgttttccacaccatcaccctctgggcagctgtca

SEQ ID NO: 1970 - DNA, 1820 bp, Homo sapiens
ggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatggatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtcctctacaagcctggtgatgcccacacaccacttacttcgtgcgcaacaacaaggaccctgttttccacaccatcaccctctgggcagctgtcatggaaaagcccagtgacctgaccggcacctgcgagaggtccctgcttacctgac

SEQ ID NO: 1971 - DNA, 1971 bp, Homo sapiens
agaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtgatgcccacacaccacttacttcgtgcgcaacaacaaggaccctgttttccacaccatcaccctctgggcagctgtcatggaaaagcccagtgacctgaccggcacctgcgagaggtccctgcttacctgacggacgtcctgctggcacctcagacaatccactctcaggaggcgcagcccgaagcccagtttcccttctat

SEQ ID NO: 1972 - DNA, 2935 bp, Homo sapiens
gccgcggctgcgccatccgcggccatgaagtttcgggccaagatcgtggacggggcctgtctgaaccacttcacacgaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgttgctcatgtctgttttgctttgtttttaagacactgaaaagaaaagctagaatttatttattcagactttaaagaacaatttctcattgatgttgtgaaaatcgtcatgtatttagacttggtgtagtagccagaattcgtaaagctgttgcctgggagcttggtactttccctccaggcagaggctctagctcagcacggcctgtagcgcacagtcagtcttgcatttcagtgtgttcaccccgctgctcctgccccttggagcccagtgacagaaagaacagcctctgtcaccccgccgccactgccttggttactcagagcactgtggggtgtcacagctgcagcatttggagtctctctcttgctgaggactcaagcccacctgagtccactcccctcttgatgcctagagagctggcccagccaacacagctcttagctgggagctccttctgccattccaactagtttcttcctggggccagttttgggtttaggttgtaattccttatatttctttcttccacagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggctggtcttgaactcctgggctcaagccacccgcccacctgggcctcccaaagtgctgggattacaggcatcagccatcacacccatccataaacattatattaatgtcacattacaaaactgagacctaagttgcttaggataaaatgaaattggaagactagctaacatgaaaatttatattttggctttttcatgttttttgataaaaccagtgtatttgaatgattcttttgatgtttagtaatggttttttgtttgttttttggtttttttttttgagacggagtctcactctgtcgccagtctggagtgctagtggcgcgatcttggcttactgcagcctccacttcccaagttcaagcgattctcctgcctcagcctcccgagtagctgggactacaggcgcatgccaccacgcccggctaatttttgtatttttagtagagacggagtttcactgtgttggccaggatggtctcgatctcgacctcgtgatcacccaccttggcctctcaaagtgctgggattacaggcgtgagccaccacgcctggcctatgtttaataatgttgaaataggatggaatattttgttaaattaacattttaaaattagaagacaccgttttaatttttaaacccttcctcctctcattgtaacgaaattaattccagctgcagtgagaaaacttaaaaatcatgatacaaaatgaaacaatatctgaaagtagttttataaaactgaaattgctgttaaagagaatgtgttagtgacttaaccatttgctctatgtgatgtttattatcaaatacatataattttgaagattttaatgaatggcttaagattttatctttgtgtagaatgtggctaaagaaaccttagttgagattcaa

SEQ ID NO: 1973 - DNA, 1125 bp, Homo sapiens
acagaggcccgccgcggctgcgccatccgcggccatgaagtttcgggccaagatcgtggacggggcctgtctgaaccacttcacacgtgagcagggaggccggagaggagcgagggaggaacggaaggaagcagtgagcgcgcggaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatg

SEQ ID NO: 1974 - DNA, 2121 bp, Homo sapiens
ctcagggcgcgacgcttttctgttacccacagaggcccgccgcggctgcgccatccgcggccatgaagtttcgggccaagatcgtggacggggcctgtctgaaccacttcacacgaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcaggtgttgtgttctgatcactggtctgtgccctcacagcaccgcacatcgacacactgtacttatttgtccctctctaacattttaactaaaagttgattcaacaacacacagttggataaacatatcacttcatgttgctcatgtctgttttgctttgtttttaagacactgaaaagaaaagctagaatttatttattcagactttaaagaacaatttctcattgatgttgtgaaaatcgtcatgtatttagacttggtgtagtagccagaattcgtaaagctgttgcctgggagcttggtactttccctccaggcagaggctctagctcagcacggcctgtagcgcacagtcagtcttgcatttcagtgtgttcaccccgctgctcctgccccttggagcccagtgacagaaagaacagcctctgtcaccccgccgccactgccttggttactcagagcactgtggggtgtcacagctgcagcatttggagtctctctcttgctgaggactcaagcccacctgagtccactcccctcttgatgcctagagagctggcccagccaacacagctcttagctgggagctccttctgccattccaactagtttcttcctggggccagttttgggtttaggttgtaattccttatatttctttcttccacagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggctcaccgcattgacctccttggctcaaggcatcctcccacctcagcttcctgactagctgggactactggtgtgcaccaccacacccagctaattttcaatttttcatagagacagggtctcactgtgttgtccaggagttggagaccagcctggccaacatggtgaaaccacgtctctact

SEQ ID NO: 1975 - DNA, 1304 bp, Homo sapiens
acagaggcccgccgcggctgcgccatccgcggccatgaagtttcgggccaagatcgtggacggggcctgtctgaaccacttcacacgtgagcagggaggccggagaggagcgagggaggaacggaaggaagcagtgagcgcgcggaatcagtaacatgatagccaagcttgccaaaacctgcaccctccgcatcagccctgataagcttaacttcatcctttgtgacaagctggctaatggaggagtgagcatgtggtgtgagctggaacaggagaacttcttcaacgaatttcaaatggagggtgtctctgcagaaaacaatgagatttatttagagctaacatcggaaaacttatctcgagccttgaagactgcccagaatgccagggctttgaaaatcaaactgactaataaacactttccctgcctcacggtctccgtggagctgttatctatgtcaagcagtagccgcattgtgacccatgacatccccataaaggtgattcctaggaaattgtggaaggacttacaagaaccggtggtcccagatcctgatgttagtatttatttaccagtcttgaagactatgaagagtgttgtggaaaaaatgaaaaacatcagcaatcaccttgttattgaagcaaacctagatggagaattgaatttgaaaatagaaactgaattagtatgtgttacaactcattttaaagatcttggaaatcctccattagcctctgaaagcacccatgaggacagaaacgtggaacacatggctgaagtgcacatagatattaggaagctcctacagtttcttgctggacaacaagtaaatcccacaaaggccttatgcaatattgtgaataacaagatggtgcattttgatctgcttcatgaagacgtgtcccttcagtatttcatccctgcgctgtcctagcaccctgtcgctggagttggcatgcagagactttgtcaggatgggagaggccgcagtgtatcggatctgtcgttctggaaagaagacccttctatttagagtagaaacaaacgaaacttctaaggtatcatctgtgttaagtgatgagaccatatttctttgatgtttctgaacatcaaagctgattcagtactggtagatgtgctcattctccctgaaacatacccatcatatttcctattataattacatctcattgtcctgtggaggtggacatgataaacattatcttttgttttcttgttttgttttgtttgagacggtctcattctgtcacccagactggagtgcagtgccacaatcatggct

SEQ ID NO: 1976 - DNA, 2872 bp, Homo sapiens
gggaagtgcgcttgcgcaaatgctaggttacacttgagtaactccgggaatgactgggtgggtggggcggggaacagtaacggtctcctattggatggcagcctaaactcgcaggccagctaattggacgcaatcagaacccagcattctttcttcgtgttcctgtgcgggattggtgtgcccaggggtttggctttccaattggctaacgccggggtgggtggggaatgtggggagatttgaatttgaaaccggtagggagtgataatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacagcaaaaagaatctaaacaaaatcttaatgttgacaaagatactaccttgcctgcttcagctagaaaagttaagtcttcggaatcaaagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctacttt

SEQ ID NO: 1977 - DNA, 2988 bp, Homo sapiens
gccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacagcaaaaagaatctaaacaaaatcttaatgttgacaaagatactaccttgcctgcttcagctagaaaagttaagtcttcggaatcaaaggaatctcaaaagaatgataaagatttgaagatattagagaaagagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaaccaa

SEQ ID NO: 1978 - DNA, 3098 bp, Homo sapiens
ggggtttggctttccaattggctaacgccggggtgggtggggaatgtggggagatttgaatttgaaaccggtagggagtgataatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacagcaaaaagaatctaaacaaaatcttaatgttgacaaagatactaccttgcctgcttcagctagaaaagttaagtcttcggaatcaaagaaggaatctcaaaagaatgataaagatttgaagatattagagaaagagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaaccaa

SEQ ID NO: 1979 - DNA, 2468 bp, Homo sapiens
aatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacagcaaaaagaatctaaacaaaatcttaatgttgacaaagatactaccttgcctgcttcagctagaaaagttaagtcttcggaatcaaagaaggaatctcaaaagaatgataaagatttgaagatattagagaaagagattcgtgttcttctacaggaacgtggtgcccaggacaggcggatccaggatctggaaactgagttggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaa

SEQ ID NO: 1980 - DNA, 2084 bp, Homo sapiens
tccgcattcagttgtcgaggagtgccagtcaccttcagtttctggagctggccgtcaacatgtcctttcctaaggcgcccttgaaacgattcaatgacccttctgattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacat

SEQ ID NO: 1981 - DNA, 1175 bp, Homo sapiens
attctttcttcgtgttcctgtgcgggattggtgtgcccaggggtttggctttccaattggctaacgccggggtgggtggggaatgtggggagatttgaatttgaaaccggtagggagtgataatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacagcaaaaagaatctaaacaaaatcttaatgttgacaaagatactaccttgcctgcttcagctagaaaagttaagtcttcggaatcaaagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaaaagaaacaaatgagaagaaagaaa

SEQ ID NO: 1982 - DNA, 1171 bp, Homo sapiens
agctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgcccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttcca

SEQ ID NO: 1983 - DNA, 3027 bp, Homo sapiens
gctttattgtttgcttgttttgttccggagtcggggccgggagggagtgcaggaggagggatccaagcttccaagcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatggcatctctggtgtatactgattgagaaaataattaaactgaagttaggggagggg

SEQ ID NO: 1984 - DNA, 1535 bp, Homo sapiens
gacagagcagagtccacttctcatctccagtatccgtaaaaatttgtccaaaatgtaactaagaaaacacaatgatattagttacttctgctccccgtcaccctcaaccccactgattacgagatgggaactcacacaaaactttgagacaaaagagcaacaagtttgctttattgtttgcttgttttgttccggagtcggggccgggagggagtgcaggaggagggatccaagcttccaagcctctgctccgctctccttctatccagttggtctttagggcactgaaggaaactcttcttcagaaataaccttttaacttttcttctgtcagctgcctgccaatcacggagccagaggctgaggggaggctttgagccggtctgcgagtccggaaggcaaagatcgcgaagcttggcgctccagaacgctcagggggcaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacac

SEQ ID NO: 1985 - DNA, 1046 bp, Homo sapiens
agaacgctcagggggcaggtgacacagtcgtgggttccccggcgggcgctggcttgacagtttcctccccgcccactggcaggggagcgccccgccgggctgcacgcgcgcgcgcgcaggggggcataaaagccgcggccgcgcggagacgcggagctcgcccaccgcccgccccagcagtggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagaggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggat

SEQ ID NO: 1986 - DNA, 583 bp, Homo sapiens
atgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcagcccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagc

SEQ ID NO: 1987 - DNA, 3053 bp, Homo sapiens
atgacttttcctgaagcggacattttacttaaatcgggagagtgtgctgggcagacgatgctggacacgatggaggcgcccggccactccaggcagctgctgctgcagctcaacaaccagcgcaccaagggcttcttgtgcgacgtgatcatcgtggtgcagaacgccctcttccgcgcgcacaagaacgtgctggcggccagcagcgcctacctcaagtccctggtggtgcatgacaacctgctcaacctggaccatgacatggtgagcccggccgtgttccgcctggtgctggacttcatctacaccggccgcctggctgacggcgcagaggcggctgcggccgcggccgtggccccgggggctgagccgagcctgggcgccgtgctggccgccgccagctacctgcagatccccgacctcgtggcgctgtgcaagaaacgcctcaagcgccacggcaagtactgccacctgcggggcggcggcggcggcggcggcggctacgcgccctatggtcggccgggccggggcctgcgggccgccacgccggtcatccaggcctgctacccgtccccagtcgggcctccgccgccgcctgccgcggagccgccctcgggcccagaggccgcggtcaacacgcactgcgccgagctgtacgcgtcgggacccggcccggccgccgcactctgtgcctcggagcgccgctgctcccctctttgtggcctggacctgtccaagaagagcccgccgggctccgcggcgccagagcggccgctggctgagcgcgagctgcccccgcgcccggacagccctcccagcgccggccccgccgcctacaaggagccgcctctcgccctgccgtcgctgccgccgctgcccttccagaagctggaggaggccgcaccgccttccgacccatttcgcggcggcagcggcagcccgggacccgagccccccggccgccccgacgggcctagtctcctctatcgctggatgaagcacgagccgggcctgggtagctatggcgacgagctgggccgggagcgcggctcccccagcgagcgctgcgaagagcgtggtggggacgcggccgtctcgcccggggggcccccgctcggcctggcgccgccgccgcgctaccctggcagcctggacgggcccggcgcgggcggcgacggcgacgactacaagagcagcagcgaggagaccggtagcagcgaggaccccagcccgcctggcggccacctcgagggctacccatgcccgcacctggcctatggcgagcccgagagcttcggtgacaacctgtacgtgtgcattccgtgcggcaagggcttccccagctctgagcagctgaacgcgcacgtggaggctcacgtggaggaggaggaagcgctgtacggcagggccgaggcggccgaagtggccgctggggccgccggcctagggcccccttttggaggcggcggggacaaggtcgccggggctccgggtggcctgggagagctgctgcggccctaccgctgcgcgtcgtgcgacaagagctacaaggacccggccacgctgcggcagcacgagaagacgcactggctgacccggccctacccatgcaccatctgcgggaagaagttcacgcagcgtgggaccatgacgcgccacatgcgcagccacctgggcctcaagcccttcgcgtgcgacgcgtgcggcatgcggttcacgcgccagtaccgcctcacggagcacatgcgcatccactcgggcgagaagccctacgagtgccaggtgtgcggcggcaagttcgcacagcaacgcaacctcatcagccacatgaagatgcacgccgtggggggcgcggccggcgcggccggggcgctggcgggcttgggggggctccccggcgtccccggccccgacggcaagggcaagctcgacttccccgagggcgtctttgctgtggctcgcctcacggccgagcagctgagcctgaagcagcaggacaaggcggccgcggccgagctgctggcgcagaccacgcacttcctgcacgaccccaaggtggcgctggagagcctctacccgctggccaagttcacggccgagctgggcctcagccccgacaaggcggccgaggtgctgagccagggcgctcacctggcggccgggcccgacggccggaccatcgaccgtttctctcccacctagagcgcccctcgccagcccgctctgtcgctgctgcgcggccctggcccgcaccccagggagcggcgggggcggcgcgcagggcccactgtgcccgggacaaccgcagcgtcgccacagtggcggctccacctctcggcggcctcacctggcctcactgcttcgtgccttagctcgggggtcgggggagaaccccgggacgggggtgggatggggtaagggaaatttatatttttgatatcagctttgaccaaaggagaccccaggcccctcccgcctcttcctgtggttcgtcggccccctcccccggctccgcgctgctcttagagggggaggggtgtcactgtcggggcactcctagccctacctccggcccttgcgaccacacccattctcactgtgaatctccccgctggggtcggagcgtcgggcagagttggggagtggggaggggactgagccggccggagggccccccgcacccccgctcccacccaccccgggactgataatgtgaagttcctcattttgcacaagtggcactagccccagggccaacccttccttcctcagtcaccaagggcggggagttctggagtcggaaggcgaagagcctaccaccaggtctcccactcccgcggtgccctcccttcccttccctgcggccccggaccatatttattgcatgcgccccggcggccccccatcccgagcccaggctgggctgggctggaacgcggtctctttagctccctcctcttcgtttgtatatttcctaccttgtacacaggctcttccagagccgcttccattttctatactcgaaccaaacagcaataaagcagtaaccaagg

SEQ ID NO: 1988 - DNA, 3156 bp, Homo sapiens
ggctgagacgcgaccaggacgcggggaggacggaccagcaggacagaccgaccgggggcccggcgggcggagggcagcgcagccacgtcccccctggatccgccgtcagccgggcccggggctttcgacatgccccccaggagagtgtgctgggcagacgatgctggacacgatggaggcgcccggccactccaggcagctgctgctgcagctcaacaaccagcgcaccaagggcttcttgtgcgacgtgatcatcgtggtgcagaacgccctcttccgcgcgcacaagaacgtgctggcggccagcagcgcctacctcaagtccctggtggtgcatgacaacctgctcaacctggaccatgacatggtgagcccggccgtgttccgcctggtgctggacttcatctacaccggccgcctggctgacggcgcagaggcggctgcggccgcggccgtggccccgggggctgagccgagcctgggcgccgtgctggccgccgccagctacctgcagatccccgacctcgtggcgctgtgcaagaaacgcctcaagcgccacggcaagtactgccacctgcggggcggcggcggcggcggcggcggctacgcgccctatggtcggccgggccggggcctgcgggccgccacgccggtcatccaggcctgctacccgtccccagtcgggcctccgccgccgcctgccgcggagccgccctcgggcccagaggccgcggtcaacacgcactgcgccgagctgtacgcgtcgggacccggcccggccgccgcactctgtgcctcggagcgccgctgctcccctctttgtggcctggacctgtccaagaagagcccgccgggctccgcggcgccagagcggccgctggctgagcgcgagctgcccccgcgcccggacagccctcccagcgccggccccgccgcctacaaggagccgcctctcgccctgccgtcgctgccgccgctgcccttccagaagctggaggaggccgcaccgccttccgacccatttcgcggcggcagcggcagcccgggacccgagccccccggccgccccgacgggcctagtctcctctatcgctggatgaagcacgagccgggcctgggtagctatggcgacgagctgggccgggagcgcggctcccccagcgagcgctgcgaagagcgtggtggggacgcggccgtctcgcccggggggcccccgctcggcctggcgccgccgccgcgctaccctggcagcctggacgggcccggcgcgggcggcgacggcgacgactacaagagcagcagcgaggagaccggtagcagcgaggaccccagcccgcctggcggccacctcgagggctacccatgcccgcacctggcctatggcgagcccgagagcttcggtgacaacctgtacgtgtgcattccgtgcggcaagggcttccccagctctgagcagctgaacgcgcacgtggaggctcacgtggaggaggaggaagcgctgtacggcagggccgaggcggccgaagtggccgctggggccgccggcctagggcccccttttggaggcggcggggacaaggtcgccggggctccgggtggcctgggagagctgctgcggccctaccgctgcgcgtcgtgcgacaagagctacaaggacccggccacgctgcggcagcacgagaagacgcactggctgacccggccctacccatgcaccatctgcgggaagaagttcacgcagcgtgggaccatgacgcgccacatgcgcagccacctgggcctcaagcccttcgcgtgcgacgcgtgcggcatgcggttcacgcgccagtaccgcctcacggagcacatgcgcatccactcgggcgagaagccctacgagtgccaggtgtgcggcggcaagttcgcacagcaacgcaacctcatcagccacatgaagatgcacgccgtggggggcgcggccggcgcggccggggcgctggcgggcttgggggggctccccggcgtccccggccccgacggcaagggcaagctcgacttccccgagggcgtctttgctgtggctcgcctcacggccgagcagctgagcctgaagcagcaggacaaggcggccgcggccgagctgctggcgcagaccacgcacttcctgcacgaccccaaggtggcgctggagagcctctacccgctggccaagttcacggccgagctgggcctcagccccgacaaggcggccgaggtgctgagccagggcgctcacctggcggccgggcccgacggccggaccatcgaccgtttctctcccacctagagcgcccctcgccagcccgctctgtcgctgctgcgcggccctggcccgcaccccagggagcggcgggggcggcgcgcagggcccactgtgcccgggacaaccgcagcgtcgccacagtggcggctccacctctcggcggcctcacctggcctcactgcttcgtgccttagctcgggggtcgggggagaaccccgggacgggggtgggatggggtaagggaaatttatatttttgatatcagctttgaccaaaggagaccccaggcccctcccgcctcttcctgtggttcgtcggccccctcccccggctccgcgctgctcttagagggggaggggtgtcactgtcggggcactcctagccctacctccggcccttgcgaccacacccattctcactgtgaatctccccgctggggtcggagcgtcgggcagagttggggagtggggaggggactgagccggccggagggccccccgcacccccgctcccacccaccccgggactgataatgtgaagttcctcattttgcacaagtggcactagccccagggccaacccttccttcctcagtcaccaagggcggggagttctggagtcggaaggcgaagagcctaccaccaggtctcccactcccgcggtgccctcccttcccttccctgcggccccggaccatatttattgcatgcgccccggcggccccccatcccgagcccaggctgggctgggctggaacgcggtctctttagctccctcctcttcgtttgtatatttcctaccttgtacacaggctcttccagagccgcttccattttctatactcgaaccaaacagcaataaagcagtaaccaagg

SEQ ID NO: 1989 - DNA, 3555 bp, Homo sapiens
gtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 1990 - DNA, 3919 bp, Homo sapiens
gacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 1991 - DNA, 3065 bp, Homo sapiens
acagtgctgcctcgtctgaggggacaggaggatcaccctcttcgtcgcttcggccagtgtgtcgggctgggccctgacaagccacctgaggagaggctcggagccgggcccggaccccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttctt

SEQ ID NO: 1992 - DNA, 3922 bp, Homo sapiens
gacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaataggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 1993 - DNA, 3468 bp, Homo sapiens
atttgaaaacttggcaaccttggattggatggattcatatttcttagtatagaagttcttgatataactgaaaaattaagttaaacacttaataagtggtggttactcagcacttttagatgctgtttataatagatgaccttttctaactaatttacagttttttgaaagataactgagaggttgagggacggagattttcttcaagcaattttttttttcattttaaatgagctcccaatgtcggagtttggaaaacaaatttgtctttttaaaagaaggtctaggaaactcaaaacctgaagaattggaagaaatcagaatagaaaatggtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaagg

SEQ ID NO: 1994 - DNA, 2655 bp, Homo sapiens
agtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattattttt

SEQ ID NO: 1995 - DNA, 3468 bp, Homo sapiens; identical to SEQ ID NO: 1993

SEQ ID NO: 1996 - DNA, 1296 bp, Homo sapiens
atggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 1997 - DNA, 2152 bp, Homo sapiens
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacagccataaaataagtatctgttacgagtaactgaagaccccattctccaagcatcagatccatttcctatcacaacatttttaaaaaatgtcatctgatggcacttctgcttctgtcctttaccttcccatctccagtgaaaagctgagctgctttgggctaaaccagttgtctatagaagaaaatctatgccagaagaactcatggttttaaatatagaccatcatcgaaactccagaaatttatccactgtggatgatgacatcgctttcctttggtcaaggttggcagagcaagggtataaagggggaaattgtttggcagcaccaacagaaaacaaa

SEQ ID NO: 1998 - DNA, 1413 bp, Homo sapiens
atggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 1999 - DNA, 1413 bp, Homo sapiens
atggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 2000 - DNA, 1669 bp, Homo sapiens
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 2001 - DNA, 1696 bp, Homo sapiens
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 2002 - DNA, 1435 bp, Homo sapiens
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggaggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 2003 - DNA, 1837 bp, Homo sapiens
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggaggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 2004 - DNA, 1552 bp, Homo sapiens
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 2005 - DNA, 1897 bp, Homo sapiens
ctcaggagcagtctgtgcccgcagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 2006 - DNA, 1780 bp, Homo sapiens
ctcaggagcagtctgtgcccgcagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 2007 - DNA, 1362 bp, Homo sapiens
atggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtga

SEQ ID NO: 2008 - DNA, 9667 bp, Homo sapiens
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacagccataaaataagtatctgttacgagtaactgaagaccccattctccaagcatcagatccatttcctatcacaacatttttaaaaaatgtcatctgatggcacttctgcttctgtcctttaccttcccatctccagtgaaaagctgagctgctttgggctaaaccagttgtctatagaagaaaatctatgccagaagaactcatggttttaaatatagaccatcatcgaaactccagaaatttatccactgtggatgatgacatcgctttcctttggtcaaggttggcagagcaagggtataaagggggaaattgtttggcagcaccaacagaaaacaaacaaacaaaaaacagctacctaaaacttcttgaaagagttcatggagaattggtgatacagacccaaagcaaatttgccaatgatattttccacaaaaaaagtccaaaaagtatggctcagcctccccctccccacaggagaggaattggagatagatggcatgtgtgtttagatcggagttgagctccggaatggggtgaggagggacacctctattgagaggttctccttgatcaggcaggcttcggccctttttttcccatttaaatggaactgctgtattccatgaaaattcctgaaagtctgatcacggttctgcagatgtataagtcatccttgtcactcataatatgtacatactatcaggaggagtgctgttatcatggtaaaattagcactggaataggaggtcacaaaatgctggctaattagctatgtgactttgagaaatcgtttaactttttttttttttttttttttgagacaggatctcactctgttgcccaggctggagtgcagtggtgcaatcatggctcagtgcagcctcgacctccccaggctcaggtgatcctcccacctcagcctcttgagtactgggacaacaagtgcacaccaccatgtctggctacattttgttctttttgtagagataggggtctcactatgttgcccatgctggtcttgaactcctgggctcaagcaatcagcccgcctcagcctcctaaagtgctgggattacaggtgtgagccaccacacccagccttatttaactcttaaaactcagtttccggccaggctcggtggctcacacctgtaatcccaacactttgggaagccgaggcaggcgcatcatttgaggtcaggagttcgagaccagcctgacccacatggtgaaaccctgtctctactaaaaatacaaaaattagctgggcagtagtggcacatgcctgtaatcccagctactccggaggctgaggcagaaaaatcgcttaagcctgggaggttgaggttgcggtgagtggagatcacactactgcactccagtctgggcgacagagtgagaccctgtctcaaacaaaacaaaacaaaaacaaacaaacaaaaacaaaaaaaactcagtttcctcatccataaaataggaattagatttcaatgttctcttaggtcccttctagctttaattcatatgtgattatgcagtaaccacaaggtattttttaaacctcctaatgtatggatattaagcagaagagtatttatatgaatacatgtttcacattcctttggtatgaaaatggtgtgttaagtttttcctttaaccactgagttgtgaatgtgaagaaggtggtggagaggaacaaaaaacagaaaggtattttgatcttgccacaaagcatacacacaaattggcacatgcagctgtttgccaaagccttctttttttttttactttttaagaaattatgttagggaaaataaattctgcttccagggacaacttcatggagcctatttacaaattaagagtcagcttaatttgtaacatttctaccagagccaagaatcccaaattcctggtagattagtgttttatttctaaggggcttatgcattcggctccaactcaactcgtctatgtgctgccagtaattaaaatgttccacctcagactgcacaaatggcttatccttctttgtggcatggcgtctgtctcaggaaaaaaggttttatgaaattccatggcaacagtcccaacatgtttgagacttcagctaaaggaatggatgtattttggtgtgtagtcttcagtatatcactgtatttccgtaatactagactccaagctatgccagattgcttattccctttgtgaaagaggagttgctcattacgttcttgaaatatcgcacatcctgttggttcttcaagggacaagagaaagagaatttggaagcagggattagtagaagagaaaacgagggaaaggaagcctttccaccagattagtgttcaagtctttgcagaggagaccaactttttttgttttcttttgttttgagacagtctctcgctctgttgcccaggctggagtgcagtggcgcgatctcggctcacggcaacctccgcctcccgggttcaagcaattctcctgcctcagcctcccaagtagctgggattacaggtgctcaccaccaagcccggctaatttttgtatttttagtagagacaaggtttcaccatgttggccaggccagtctcaaactcctgacctcaggtgatctgcccgccttggcctcccacagtgctgggattacaggcatgagctaccgcacccagcctgagaccaccttttgcatctcaagattgtgaaaccaaggcccattccaccagcctggggactctttttatagatatgatcctcctttttcctgtgactaatgaatttgctgcatgatttctattcttctgaggttagttttctgagtaaggtgaccactcacaaaggcactttctttgtggcattctgagcctagattggggcccatcaattccagaaaaaatttatgtgtggaaactctgcatccttaagtcttgaagttgaaccagatatgcagtggttaccatcacacagataaacgctgccttctgtacataccccttatgctgtactaattaacaaaccccttgccagggctggggaggtgagggtgaaggagaatcttagcagaagggcagagtcaggacttgcatctgccactgctgggcactgaagccctggagcagcttcagatagtacctgtactttctcatgcagactccctctgaacaagagccttgtaggcccctctccttcatttcccaccagcctcttatcaggcgggctttccaccatacacccaggaggccacggtctgaggaacaaccaaacccatgcaaagggccgggcgcgatagctcacgcctgtaatgccagcactttgggaggctggggcaggcagatcacctgaggttgggagttcgagacctgcctgaccaacatggagaaacccccatctctactaaaaatacaaaattagccgggcgtgatggcacatgcctgtaatcccagctactcaggaggctgaggcaggagaatcgcttgaacccgggaggcggaggttgcggtgagccgagatggcaccactgcactccagcctcggcaacaagagcgaaactctgtctaaaacaaaaacaaacaaacaaacaaaaaaacccaggcaaagtttccttgcagccaaggtgacagaactgggctgagggtggaaaagaaacagaaccagtgctccaggtgttttttaattttttaatttatttttattttttttgtatatgtatatatatgtatgtatattttagaggaccagggtctcactatgttgcctaggccagactcaaactcctgtgctcaagcaatcctgcctcagcctcccaagtagctgggattacaggcatgcacaaacaatgcccagctctccaaatgttttctgtcactacctgaagtgttgcatcggtacttcctacggaaagaaaactaaatagaagtgtctctcccgtgagcccccaccactaccaccagaaaaaaaaaagagagaaaatgaactcatcagtctttagtttcctcaagttattctcccaaaaagacattcgccttggcacagataagccagctaatcttatgctttatgacccactgtgagctgttcctgacacagcttctgactttgtcagtgacaaaatttctcaccttttaaatgcagtgcttaacattttgttaggcccatactcaaaatcggccagatataaaatgacctcagattttgatctcctaggctcaaacaatcctcctacctcagcctcccaagtagctgggactataggcacaccaccatgcacagctaattttttttgtatttttctgcagagatggcgtttcgccatactgcccaggctagtctcaaaatcctgggctcaagcaatctgcccacctcagcctcccaaagtgctggaactacaggcaagagccactgcgcccagccacaacctcagatttctttggcaaacagaaatgtttaaaaacacaaaattttgctcaggtgaaacactgtgttactatcaaatctcacatccacataaagtttttcttttcggctttgtttcgtgaggaacagacagaacaaagtttttccaggtagcatctgtatcactattattctcctatttcctgtaccacccccacctccccaagccctactgaatgtgaggtttagaatgttttaaggagggtcaggtgcggtggctcacgcctgtaatcccagcactttgggaggccaaggcgggcggatcacctgagtttgggagttcgagaccagcctgaccaacatggagaaaccctgtctctactaaaaatacaaaattagccaggcgtggtggcacatgcctgtaatcccagctacttaggaggctgaggcaggagaatcgcttgaacccaggaggaggaggttgtggtgagccgagatcgtgccattgcactccagcctgggtgacagagtgagactccatctcgaaaaaaaaaatacaaaaattagctgggtgtggtggtgcacacctgtaatcccagctactcgggaggctgacgcaggagaattgcttgaacctgggaggtggaggttgcagtgagccgagatcgcgccattgcaatccagcctggacaacagagtgagactccatctcaaaaaaaaaaaaaaaaagaatgttttaaggaaaaaaatagtactgttacatataatcccaggtgataagaccacaatggaaatgtttaagtcctcactttaaagagtaccccactgagaagaggtatgttggactctagcagagatttggaaactctgggacactcaagatgtgaaagagcctggctatctgaggactcaaagagtcagcatcgggacttgtgagctcaagaagagaaaagggagtggtgaaactttgtcctaaaagttagcaccaggaacagaagaaaaaaacccgatatatagtgatacctcatcttttagagaatgggaagctatttttgtgttcacacagaaagtatagttcaaaaaacctctatatccagagttcagacaaggagaatgatttgagatataagtgccgatgaaggaggtcaattttgatctgaaaccagcagctggacctgggccacctcaggaaaaggactctgttctccaaggcagcacgactgaatggttctgagaataagccagggttcaggactcctgaccctttaggaccatggactcagaagagcctgaaggacaattgtgggctttaaacttctgagagcttgtaaagtaacacaagactgtgcctctcccttgccccagctgtagatagtctttgccccaccattgttatgaagatacacagggttttgcagtttgaataaattggatacaagtttcctctttttttttttctttttgagacaaagtctcgctctgtttccccaggctgagtgcagtggcacaatcaaggcttacttgccgcctcaacctcctgggctcaagcaacgagccatcctcccgtcttagcctcccaactagctgagactacaggcgtgggtcaccacacccagctaatttttgtactttttgtagagacagggtctcaccatgttgcccaggctggtcctgaactcctgggctcaagtaatctgcccacctcagcctcccaaagtgttggggttacaggcgtgaggcaccgcggctggcctgagtttcttcttaatactgtatcacaattgtgggctgtcttatgtgttgatatcgattgagctatttgaaataggaatgttaatgggtgtattaaatttttgtaaggatataacaatatctaccttccaaggatgttgtgaggttttccatgattttgtatatgagctaatgttacctttgaggggtggtgtgcattatgttggatgattgtaaattttcagtggaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgagctaaccacgtgctatagacacttcatggtgtcgcacccagggaagtcaaagcgctttgctccctcactgtctgtgagtcctcagccattagtaccccaccccccgctgctccaaaacttgagttatttcaaatgtttctcactgttcatctctccactgaccccactccagaaagcctggagagagtcccaagatgccacccaccttccccaatccctcgccacagatctgtgtctatctcacactctgtaagtgccgctttgcttcttcctctcttgaaaagactgagaacacacattttaacatgttaggaaaatggggcagcctaaaaaatgactgatcccaccgccagtgactcatgtatactccaggctagcagacaaggccctttttggtgggcctgcttctgtgggttcacagaaaccaaattactgtgggttgcaaagaattagcaggtcatttacaaagcagacatcccttcacccagactgtggttttgcatgctcaggttctcagtctatgagctttggtgcaggatcattttggctactggaaaaaccatagcttattttaaatttctggttgccaaagccaccacacgtgtggtctgtggatgaccattgtctgcagaatgacgaggaaggaacagaatgtggtttggggctcagggtggccttcccactgggagggaaggcgggagggagcccttgccctgggttttgacacagcctgtgctcacagcctctcctctcatctgcatttctcagaaatgccctccctgcccagtggtgactttccctcgtcactcctatggagttctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttgaaatta

SEQ ID NO: 2009 - DNA, 1996 bp, Homo sapiens
gcaggagcacgtggagaggccgagtagccacagcggcagctccagcccggcccggcagcgacatggaagatatacaaacaaatgcggaactgaaaagcactcaggagcagtctgtgcccgcagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 2010 - DNA, 1222 bp, Homo sapiens
attccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggtgagatccagatccgaccactagatcatccttataccgacggggaaacggaggccagagagggcgtgggcgcttgcaccacttccgtcccatccttgcgggtacctggctatgcgggggtgcctaaggagcctggaaaaagcgctcccccgtcgtgcttcctggggaagggggcgttcgctgcgctcggagcggcgtcccttccaacccgccggtctcatttcttctcgttttcacaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtg

SEQ ID NO: 2011 - DNA, 994 bp, Homo sapiens
actctcattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgtctgagcagagcgtggccatctcgcgctgcgccgggggcgccggggcgcgcctgcctgccctgctggacgagcagcaggtaaacgtgctgctctacgacatgaacggctgttactcacgcctcaaggagctggtgcccaccctgccccagaaccgcaaggtgagcaaggtggagattctccagcacgtcatcgactacatcagggaccttcagttggagctgaactcggaatccgaagttggaacccccgggggccgagggctgccggtccgggctccgctcagcaccctcaacggcgagatcagcgccctgacggccgaggcggcatgcgttcctgcggacgatcgcatcttgtgtcgctgaagcgcctcccccagggaccggcggaccccagccatccagggggcaagaggaattacgtgctctgtgggtctcccccaacgcgcctcgccggatctgagggagaacaagaccgatcggcggccactgcgcccttaactgcatccagcctggggctgaggctgaggcactggcgaggagagggcgctcctctctgcacacctactagtcaccagagactttagggggtgggattccactcgtgtgtttctattttttgaaaagcagacattttaaaaaatggtcacgtttggtgcttctcagatttctgaggaaattgctttgtattgtatattacaatgatcaccgactgaaaatattgttttacaatagttctgtggggctgtttttttgttattaaacaaataatttagatggtggtaaa

SEQ ID NO: 2012 - DNA, 1348 bp, Homo sapiens
acttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaag

SEQ ID NO: 2013 - DNA, 2854 bp, Homo sapiens
gcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctggagcccgcagcccccagggcctgggacggtgaggggcgtgaatgcggcggggggcggggccgttgccgggggagggggccggggcgcatgcgcgctgcgcagcggggctgaatgtttcccaagtgtttgaaactggtatttgggttttccacgttggacaagtgcggctcggcggccagcggagcgcgccccttcccgctgcccgctccgctcctctcttctacccagcccagtgggcgagtgggcagcggcggccgcggcgctgggccctctcccgccggtgtgtgcgcgctcgtacgcgcggcccccggcgccagccccgccgcctgagagggggcctgcgccgccggccggggcgtgcgcccgggagccaccgccaccgcggcccgcgccctcaggcgctggggtccccgcggacccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaaccatgttgagtcctgccaacggggagcagctccacctggtgaactatgtggaggactacctggactccatcgagtccctgcctttcgacttgcagagaaatgtctcgctgatgcgggagatcgacgcgaaataccaagagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaacaca

SEQ ID NO: 2014 - DNA, 1189 bp, Homo sapiens
cctccgagaacggtgtccatgacacagggcgggaagagataaggcctagggaaggcgcccctcgggcctatccacctcttctggggctcggcactaggaagcagcttccctctcaggcccctttgtctccaagccgttccaaactgagtaccgggagacgacacaaagggagggcggtgacggatggcgcaggcgcgggagccgcctaggctgctgggagtggtggtccggccgcggaatggagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaaca

SEQ ID NO: 2015 - DNA, 2870 bp, Homo sapiens
agcggaggcggggaaggcgcccatctgcgctgcgctcgggggggcgcgggcagatcgctggcttggagaggactgtggcaggtgagaggacctgtgcgtcgttctctgcagacctggccgccccgggtgtcagagagaggtggcgagttcgtgtccgccgggaattgttggctgttggggaaactttcctgcgaggtcagtcaaggctttgggggctctgttttgaatgtggatcaccactcggagtttactaatgtttacaaggctgcgcagtagggaaacggaagagttgggtgggggcaaaaaaaaaaattgaccgctatccccgaaagtactagacgcctctgccgggaaggcgcccctgcgcgttctatccgagacgtagcttcgcagcgaattttataggaacttcattagcatattatggaacgtcccgcctcagccccccagtagttggctgtgatgtccttcgtggaatgtccttatcattcccctgcggaacgattggtcgctgaggcggatgaaggcgggcctagcgcaataactggtatgggtctgtgtttccgctgtcttcttttttctttttcggggaggagcggggtggagggtggacgagttgatttgaacgtcttcgggtcgctcggcctccagccttggattggttcttctcgctgctggggcgggccgtgctcttccgccctgcggtgtggttggttctcctcctggcctccgccctccaaatcggcgattcccataggcggcggctctcggggtgcggggcgagtctcccgctggcctcctccccattggctggaggcctggcgggtgtcgcccctgcccctctccccgctcagcccggccactttcgggcgcggatttatagcagtagcagtgatcccgggcctgtgggctcggggccggggctgcagttcggaccgcctcccgcgacccgcggggccggctcggagacagtttcaggccgcatctctgctgacccgagggtggggccgcgcgtggccgtggaaacagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaac

SEQ ID NO: 2016 - DNA, 1074 bp, Homo sapiens
cgccgtccacaccccagcggccctgacgctgtcccctccgcgaccctcgcctctggaaaaagtgacaggcaaggccacgcccccgcgagggccggcctggagcccgcagcccccagggcctgggacgagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaaca

SEQ ID NO: 2017 - DNA, 1709 bp, Homo sapiens
acagtcacttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagagccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttggcctgctgtgtttattgtagagacactgttttagtaaacatgctgagcattcattttgcgtcctctgggttggatgcaatgtgagaggatggcatgccagaattaggacacgacatgaaaccagagtggtgcctctgtccgagaacttgtaagttctcaacttgggaaagacagaggtgctggagggtaggcctcagaccagggggtctccaaaactttgtaaatcatgcatcttttctccataaaacatctttcacttaatttccaataaatgatgtatttgtgctatacatacgtactgctatactata

SEQ ID NO: 2018 - DNA, 1393 bp, Homo sapiens
ttccggggcggatcggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttg

SEQ ID NO: 2019 - DNA, 741 bp, Homo sapiens
atggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaagaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatag

SEQ ID NO: 2020 - DNA, 602 bp, Homo sapiens
atggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcactgttccattgagtggttccattttgcctgtgtggggctgacaaccaagcctcgggggaaatggttttgcccacgctgctcccaagaacggaagaagaaatag

SEQ ID NO: 2021 - DNA, 678 bp, Homo sapiens
atggctgcggggatgtatttggaacattatctggacaacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagaaaggccggactcaaaaggagaagaaagctgctcgtgctcgttccaaagggaaaaactcggatgaagaagcccccaagactgcccagaagaagttaaagctcgtgcgcacaagtcctgagtatgggatgccctcagtgacctttggcagtgtccacccctctgatgtgttggatatgcctgtggatcccaacgaacccacctattgcctttgtcaccaggtctcctatggagagatgattggctgtgacaaccctgattgttccattgagtggttccattttgcctgtgtggggctgacaaccaagcctcgggggaaatggttttgcccacgctgctcccaagaacggaagaagaaatag

SEQ ID NO: 2022 - DNA, 5981 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgcctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccgggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttcttctgtcccctccccccaccacttctgtaagtttcctgctctattcccaccatttttttctgtgcacacattatgatatatttcatttcctgcattgtcttgagaaagatggtaaggcaagtgagctgttgctaaccagaaattaaaattccagtaagtgtttttcattatgaccagggc

SEQ ID NO: 2023 - DNA, 1097 bp, Homo sapiens
cttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggttggccaaagacacatccaggaggggaacagaaggaggggacagaagcaagtctgcagatcagaggaaagaagaaagagcagaggagggagattggaagtagaaatgctgaatgcagaggcaaaaaaggaaaatgaaggacaggaggattaaacagacagaggcaaggatgatgagagaggagcagacagcaagaatgaaaagcagaaaatacaatagaggaaatgaagaaaagtaggcctgctggagctagatgatgatgtgatggaaatagaagtaaccttttagagaatctcgctaagaaacatggagaaaacggaaaagaaaaatgtaatgccctagaaagcgcaaagaaagacagtggcaaaaatgaaaaaaaaaaataaaaattataaaagaggcaaaaaaagacacactattctctgcctctaaaacacaattaaataaaagaatttaaataaaaa

SEQ ID NO: 2024 - DNA, 7359 bp, Homo sapiens
gaaggcaaatgttcccccagctgtttcctgtctacagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaa

SEQ ID NO: 2025 - DNA, 761 bp, Homo sapiens
aatgttcccccagctgtttcctgtctacagtgtctgtgttttgtagataaatactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatt

SEQ ID NO: 2026 - DNA, 444 bp, Homo sapiens
ttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtagagggagtgcaggaaacaagaacta

SEQ ID NO: 2027 - DNA, 612 bp, Homo sapiens
gcatacctgcctgggtgtccaaatgtaactagatgctttcacaaaccccacccacaaagcagcacatgtttttaagacttcagttttctattcacatcggcctcataatacccaccctgacctgctgtaaaagacctggaacaaacaaaaatgattacacctacagtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctt

SEQ ID NO: 2028 - DNA, 7370 bp, Homo sapiens
ttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 2029 - DNA, 11803 bp, Homo sapiens
gggaaggagctcgccgcggcggcggcggcgctgagggaggaggcggcggcgagcggagccaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagcccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 2030 - DNA, 5138 bp, Homo sapiens
ccgctaatgtaccatgccctggtgctggaaagtgcctgagccagctgccccagcggcctcagcactaccaagttggcacaaagctccccaaattcggaggggctcagggaaacgagtggaggggatgaggaggtgaggggtaaacccatcatttcagttggcatttgagcaggtgccatgctcagcggagatgaggctctcccatctgtaggggccgtattaacatgcacactctaaaagtgcccttcgtttctccagcctcagctttgtccctctcctcctccacgtcaacctggccagagggtctggacgccacagccagggcaccccctgctttggtggtgactgctaatattggccaggccggcggatcatcgtccaggcagtttcggcagagagccttgggcaccagtgactccccggtcctctttatccactgtccaggagctgcggggactgcgcagggactagagtacaggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatg

SEQ ID NO: 2031 - DNA, 1047 bp, Homo sapiens
caggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacatacc

SEQ ID NO: 2032 - DNA, 5136 bp, Homo sapiens
agccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggcctcagctttgtccctctcctcctccacgtcaacctggccagagggtctggacgccacagccagggcaccccctgctttggtggtgactgctaatattggccaggccggcggatcatcgtccaggcagtttcggcagagagccttgggcaccagtgactccccggtcctctttatccactgtccaggagctgcggggactgcgcagggactagagtacaggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagagccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtc

SEQ ID NO: 2033 - DNA, 828 bp, Homo sapiens
aactggacattagcttctcctgtgaaagagacttccagcttcctcctcctcctcttcctcctcctcctcctgccccagcgagccttctgctgagctacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccc

SEQ ID NO: 2034 - DNA, 1023 bp, Homo sapiens
tccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcgacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaaccc

SEQ ID NO: 2035 - DNA, 1005 bp, Homo sapiens
aactggacattagcttctcctgtgaaagagacttccagcttcctcctcctcctcttcctcctcctcctcctgccccagcgagccttctgctgagctgtagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaa

SEQ ID NO: 2036 - DNA, 4527 bp, Homo sapiens
gcaaactggacattagcttctcctgtgaaagagacttccagcttcctcctcctcctcttcctcctcctcctcctgccccagcgagccttctgctgagctgtagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttc

SEQ ID NO: 2037 - DNA, 5179 bp, Homo sapiens
cgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttc

SEQ ID NO: 2038 - DNA, 5585 bp, Homo sapiens
gcctgctctccggcggagctgcgtgaggcccggccggccccggccccccccttccggccgcccccgcctcctggcccacgcctgcccgcgctctgcccaccagcgcctccatcgggcaaggcggccccgcgtcgacgccgcccgctgcctcgctgctgactcccgtcccgggcgccgtccgcggggtcgcgctccgccgggcctgcggattccccgccgcctcctcttcatctacctcaactccccccatccccgcttcgcccgaggaggcggttccccccgcaggcagtccggctcgcaggccgccggcgttgtcacccccccccgcgctccccctccagccctccccccggcgcgcagcctcgggccgctcccctttccgcgctgcgtcccggagcggccccggtgccgccaccgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttc

SEQ ID NO: 2039 - DNA, 934 bp, Homo sapiens
ggcactgaccagcctgcaaactggacattagcttctcctgtgaaagagacttccagcttcctcctcctcctcttcctcctcctcctcctgccccagcgagccttctgctgagctacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccc

SEQ ID NO: 2040 - DNA, 1583 bp, Homo sapiens
cactgcagcttccccaaccccgcgcacagcgggcactggtttcgggcctctctgtctcctacgaagtccccagagcaactcggatttgggaaatttctctctagcgttgcccaaacacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaat

SEQ ID NO: 2041 - DNA, 2508 bp, Homo sapiens
ccagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaa

SEQ ID NO: 2042 - DNA, 1050 bp, Homo sapiens
gcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgcgccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttatttt

SEQ ID NO: 2043 - DNA, 2208 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatt

SEQ ID NO: 2044 - DNA, 810 bp, Homo sapiens
gtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaagggtgagtactcaggaggggcagcctggggctccagggcctcactgtccttggaccagcctcaggggctgggcgtggccactggcccttccccaggcttacagacccaggagctgcagctcagggccagaaagagcaaagcaaataggacagagccctcagaagggtgcagggagagggagaccccatcaacccaaccaaacaagtgtggggaaggaggccggccagtgcacctcagggacactctgctttatctcagatacctcacagcacctaagctatcattcatccacacacaaagtgaagattttcaaagttaggctttacccgtgaggtct

SEQ ID NO: 2045 - DNA, 894 bp, Homo sapiens
tggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggatacctcacagcacctaagctatcattcatccacacacaaagtgaagattttcaaagttaggctttacccgtgaggtctggaggtccatttatcttcacagagaaaccgttttaatccgcaagaacctgctaaagatacatgtttctaaattaaagatgtgaatgtgagacagctgaaatagctcagttgggagagcatcagtttgaagatgcagctttttttttctgtaaaatatataatgaatattctgttagtctgtggctaatataattttaataaagttaatttaaatctgatagaaaaatgaaattttaaacgataattttagagaatgctattatatccagtcttcttttttcttttaataaatgagggaactattgggggaaaggaataaatacattttctttcattttattaagacaaatttagtaagcagaagaaatt

SEQ ID NO: 2046 - DNA, 792 bp, Homo sapiens
atgcagcgggcgcgacccacgctctgggccgcttgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtag

SEQ ID NO: 2047 - DNA, 2327 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcggcatctacaccgagcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatt

SEQ ID NO: 2048 - DNA, 2193 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggacggccgcgggctctgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccatt

SEQ ID NO: 2049 - DNA, 2406 bp, Homo sapiens
atgcagcgggcgcgacccacgctctgggccgctgcgctgactctgctggtgctgctccgcgggccgccggtggcgcgggctggcgcgagctcggcgggcttgggtcccgtggtgcgccgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaagggg

SEQ ID NO: 2050 - DNA, 6215 bp, Homo sapiens
ggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaaacgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaagccgaaaaaaaaaaaaaaaacacctgaatgcggaagagctcggctcccgtttagcattttgtacttaaggaaataaaaaaccaacaaaggatctcacattttcttaaaaagtgaagattgctgtatactatttattcaacttataatttatgttactccttgatctttgtcttttgtcatgacaaagcatttatttaataaagttatgcattcagtta

SEQ ID NO: 2051 - DNA, 4189 bp, Homo sapiens
gccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctattgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaattacttctgga

SEQ ID NO: 2052 - DNA, 2617 bp, Homo sapiens
ataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaaagaagtga

SEQ ID NO: 2053 - DNA, 4444 bp, Homo sapiens
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggatgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaa

SEQ ID NO: 2054 - DNA, 5797 bp, Homo sapiens
aacgggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagccaaagatactagtgccaaagcaatgggattcggggtttttttctgttttcgctctatgtaggtgatcctcaagtctttcattttccttctttatgattaaaagaaacctacaggtatttaacaacc

SEQ ID NO: 2055 - DNA, 5618 bp, Homo sapiens
ttgataaaacgcctgcgagtctccagagaacaacgggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagc

SEQ ID NO: 2056 - DNA, 5795 bp, Homo sapiens
aacgggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagccaaagatactagtgccaaagcaatgggattcggggtttttttctgttttcgctctatgtaggtgatcctcaagtctttcattttccttctttatgattaaaagaaacctacaggtatttaacaacc

SEQ ID NO: 2057 - DNA, 5927 bp, Homo sapiens
aacgggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagccaaagatactagtgccaaagcaatgggattcggggtttttttctgttttcgctctatgtaggtgatcctcaagtctttcattttccttctttatgattaaaagaaacctacaggtatttaacaacc

SEQ ID NO: 2058 - DNA, 5298 bp, Homo sapiens
atggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatc

SEQ ID NO: 2059 - DNA, 3544 bp, Homo sapiens
acgtcgtggcttccgggcaggtaccgggcagctggagacgccagagccggcgggttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgtt

SEQ ID NO: 2060 - DNA, 3390 bp, Homo sapiens
atggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactca

SEQ ID NO: 2061 - DNA, 3258 bp, Homo sapiens
atggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactca

SEQ ID NO: 2062 - DNA, 4120 bp, Homo sapiens
gccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 2063 - DNA, 4348 bp, Homo sapiens
gggcgccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttgggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagtgtggcttcttccatcggagcagccagagctcatcttttcccaccaactatcaccgggcctgtctggctgtgcagccttcagccatggaagttgggggtccagggactgtgggatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttatt

SEQ ID NO: 2064 - DNA, 3835 bp, Homo sapiens
gggcgccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttgggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagtgtggcttcttccatcggagcagccagagctcatcttttcccaccaactatcaccgggcctgtctggctgtgcagccttcagccatggaagttgggggtccagggactgtgggatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttatt

SEQ ID NO: 2065 - DNA, 4216 bp, Homo sapiens
gggcgccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagtgtggcttcttccatcggagcagccagagctcatcttttcccaccaactatcaccgggcctgtctggctgtgcagccttcagccatggaagttgggggtccagggactgtgggatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttatt

SEQ ID NO: 2066 - DNA, 4228 bp, Homo sapiens
gggcgccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagtgtggcttcttccatcggagcagccagagctcatcttttcccaccaactatcaccgggcctgtctggctgtgcagccttcagccatggaagttgggggtccagggactgtgggatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttatt

SEQ ID NO: 2067 - DNA, 3763 bp, Homo sapiens
gacacagagtgagtagacaaggcttcacatactgggagatctggctgggcttcaagagagggggttggtggtggtgtggctaagttccaaatgttggcctgaagccagtgctcaaagaaagggggcccttgagacagtccaaatggctccctttgccactcccatggttcaagctttgactacaaccagaattcagaggcaggcagaaggattccagtgctggagagaatgtggaacaaggagatctccatttgagggcaaggaaacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaac

SEQ ID NO: 2068 - DNA, 3935 bp, Homo sapiens
ctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaa

SEQ ID NO: 2069 - DNA, 3930 bp, Homo sapiens
tcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggcacggccagggtggagctctgtgcacagggctcagcggacctggcacacctggacgacggtccctacgaggcggggggagagaaggagcaggacccccgcctcatcccggtccctgccaacagctactttgggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagg

SEQ ID NO: 2070 - DNA, 7030 bp, Homo sapiens
cctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatgtctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggtacca

SEQ ID NO: 2071 - DNA, 6903 bp, Homo sapiens
ggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacgtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatgtctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcatttttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagtaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaaagagactttactggcttaagagggctgtgaaagatttttgatagtgaatcatgaccctaagggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatactcagtgttttggagagtattccttttagtttgttggttggctggtttgaacgatagaaatatgcagcatgcaatatatgcttatatttcattttaatttctgatatataatgaacttcttgggagaggtactgaatctttgatgttttttgtcattgttctcaagtgcaatataacaatgtaaccaaatctagataatttcaaagttgtcattaatttagtaagcctaatataaacaaatatttgtattatttttgttagcaggaaagagtgattaagtgaggttatttacccctaaatggtccattctgcattgtatttcaggctggaaatgaattattctttaccagttttgaaacactttgaaatatcctaaggtaacttggaagctgtgtagtatatcaaattaatttgctacctaataacatagaaagtaaatatctttgtggtcacccacattgggtgagacagaaaatgaatctgttctaaaatttgtaatttgctaacttgatttgagttagtgaaaactggtacagtgttctgcttgatttacaacatgtaacttgtgactgtacaataaacataagcatatggt

SEQ ID NO: 2072 - DNA, 3288 bp, Homo sapiens
ctttgtagctcctggagattcaattctttcttgccagggtctttctacctctgcctcacatattccctccatctcttcattccacttccctcatccccaccccccactcccctccatcctcaatacacaaatgctcctaggcaccctccttctgatcctgtacatcttaatgttgtgccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatgtctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgt

SEQ ID NO: 2073 - DNA, 2271 bp, Homo sapiens
agcctcagacgctgcgtggagcggcggagccggagggaagcaaaggaccgtctgcgctgctgtccccgccccgcgcgctctgcgcccctcgtccctggcggtcgctccgaagctcagccctcttgcctgccccggagctgtcccgggctagccgagaagagagcggccggcaagtttgggcgcgcgcaggcggcgggccgcgggcactgggcgcctcgctggggcggggggaggtggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagtaacagtcatttctgaaaatatgttggatagaaagtcactctttggcaaaagtgttagaatttgcttttgtgccatctattccttttatggcatctatcttga

SEQ ID NO: 2074 - DNA, 3640 bp, Homo sapiens
agcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 2075 - DNA, 3758 bp, Homo sapiens
ggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgtctctctctgtcgcccagcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatactt

SEQ ID NO: 2076 - DNA, 3784 bp, Homo sapiens
gagccagcccagccgcgttccgaacgtgagggtcgccggcctgggcgctgtcacgtcggggctgccggagctgcgggggaccgggcccgaacggcccctgacacctgcggtctcccgccgggctgggcaagcgcagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagc

SEQ ID NO: 2077 - DNA, 500 bp, Homo sapiens
gaacagcaggcccgagcccaccgcgccgggccccggacgccgcgcggaaaagatacctgatcagagaagcagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatggaaaggcaaaaaagtccgcaggcatagagagtggaaagaaggaacagcatactaggctggtttgaaaaacaatcaattgctagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcaca

SEQ ID NO: 2078 - DNA, 569 bp, Homo sapiens
agcccgcgggagaggcccagcgggagtcgcggaacagcaggcccgagcccaccgcgccgggccccggacgccgcgcggaaaagatacctgatcagagaagcagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaa

SEQ ID NO: 2079 - DNA, 3729 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagc

SEQ ID NO: 2080 - DNA, 445 bp, Homo sapiens
acacctgcggtctcccgccgggctgggcaagcgcagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaaga

SEQ ID NO: 2081 - DNA, 552 bp, Homo sapiens
agtgcaaacgcagtgagtcatccgcagggcgtgcggagtgtgccggctgggtccctgcagcccccaagcccggagggatgcgggaaaatcgctcttggaagatgcaattgctttaataatcgactttcacccttagtagcagaaaaacgaccgtggccacagtaccacaaagtctctgatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatc

SEQ ID NO: 2082 - DNA, 585 bp, Homo sapiens
aatgaaaagtggtcaaacaacttaacatggtgccagttttcctaagcgtgcttgccactgattgtaatgcttttattgtttggcttcttgataaatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaag

SEQ ID NO: 2083 - DNA, 540 bp, Homo sapiens
agcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcagtaagtaagacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatgg

SEQ ID NO: 2084 - DNA, 546 bp, Homo sapiens
agaaatcttaaagtagaagcgtcacaggacttgttcttccaaatgctgcatggcaaatattattaggaaatatacttaacatttatttatttttattctcaataaggagttacattcaaagtaactggaagtgacggatgagaaaaatatatctaggttggtgcacacagccatctggtcgaccttagacacgggaaggcaagcaccccctggttgaccttagacatggaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagaga

SEQ ID NO: 2085 - DNA, 562 bp, Homo sapiens
gagtttctgtgcacacactctcctgcctgctgccacgtaagacgtgccttttgcctgccgccatgtaatatgtgcctttgctcctccttcgccttctgccatgattgtgaggtctccccagccatgctgaactatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccatt

SEQ ID NO: 2086 - DNA, 2955 bp, Homo sapiens
gggccgctctctgacatcagagctgctgtagagcggagaggggcaggggtgaagggccacggtggtgcaacccaccacttcctccaaggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatgg

SEQ ID NO: 2087 - DNA, 966 bp, Homo sapiens
gggaggctggggaaggaccttgccactggggtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgag

SEQ ID NO: 2088 - DNA, 2913 bp, Homo sapiens
atccagggtgaggaaggcagcccacacttttcttggagacacatccccaaagaagtcctcacgtggctccgtttgggcagaaaccatgaattgaacgggaaaagaaatatgtcaagtatcagaaagaagagtggcatgctttgacagcaagtggactccgagtccagggcagagcctcagttagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 2089 - DNA, 3178 bp, Homo sapiens
acaggcatccagggtgaggaaggctgcccacaggcatccagggtgaggaaggcagcccacacttttcttggagacacatccccaaagaagtcctcacgtggctccgtttgggcagaaaccatgaattgaacgggaaaagaaatatgtcaagtatcagaaagaagagtggcatgctttgacagcaagtggactccgagtccagggcagagcctcagttagggggccgctctctgacatcagagctgctgtagagcggagaggggcaggggtgaagggccacggtggtgcaacccaccacttcctccaaggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 2090 - DNA, 2769 bp, Homo sapiens
gttgggcctgagaccgtcaccaagaccccttccctccacaggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 2091 - DNA, 2813 bp, Homo sapiens
gacagggccaagcccagctctcctccaagcacaggctctgctcacggaggacctggggcacactggggcagagtgcacacaccgggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 2092 - DNA, 571 bp, Homo sapiens
agaaagaagagtggcatgctttgacagcaagtggactccgagtccagggcagagcctcagttagggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggc

SEQ ID NO: 2093 - DNA, 527 bp, Homo sapiens
ctctcccaagtgtgaatctgatggaagcaggtccttctcgccgggacctcatgtgagaaatgacatgtcccacctgtctcaaggggccgctctctgacatcagagctgctgtagagcggagaggggcaggggtgaagggccacggtggtgcaacccaccacttcctccaaggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatga

SEQ ID NO: 2094 - DNA, 556 bp, Homo sapiens
agccacgttccagggcacctggctgggacctgccgcagcctctgcgcgcagcgggctccatcccccgggccacggattgggagactgaggcaggcgcgaagcccgccgcccagcctccgctagggagaccccggccacctccaggcagttttcctgaagcccggggccaggagaaggggccgctctctgacatcagagctgctgtagagcggagaggggcaggggtgaagggccacggtggtgcaacccaccacttcctccaaggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctg

SEQ ID NO: 2095 - DNA, 573 bp, Homo sapiens
aagggcgactctgatgcaaggttctgagaggcctgtggggctgtggattcctaagcagcctcagctttgggttttgcaccttaggtcttggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatc

SEQ ID NO: 2096 - DNA, 680 bp, Homo sapiens
atgcatgtatatgtgtggtgtgtgcatgcacgtggtgtgtacatgcagtcaggcacacatctgtatgcacgtacacgtgcatgtgtggtgtgtgtacacgtctgcatgtgtgtgtgtgcctgtgttgtgtgcctctgcaggggcccgctgcagctgtcctgggtgcctggctgagcaggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattg

SEQ ID NO: 2097 - DNA, 2200 bp, Homo sapiens
gcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccaactcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatcgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttgg

SEQ ID NO: 2098 - DNA, 4894 bp, Homo sapiens
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgtgccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtgattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagacca

SEQ ID NO: 2099 - DNA, 2785 bp, Homo sapiens
gactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcg

SEQ ID NO: 2100 - DNA, 3995 bp, Homo sapiens
gcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgtgccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgag

SEQ ID NO: 2101 - DNA, 1802 bp, Homo sapiens
aagagcgccacgggcggggcggggccggcggcgggctgcgggcgcggccggacgggagttccccggagaaggatcctgcagcccgagtcccgaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaa

SEQ ID NO: 2102 - DNA, 2074 bp, Homo sapiens
agtcccggtgagtgcgagaggacccgcgccccctgtcacccctcacttctcctgagtcccaagtaaggaacggagccaaccctggggaggacccccggtcccctctcccagagtatacggagcctgaacctccccacttcccccaactctgttcgcggatagggtctagttgcctgctctcggacatccgttcagcagacactacctcttcgtcaccccctgcccaccctgacccgcctttacctcgcgtctagaggacacagccagggatcatcccgcagccccgaactccttcacagacccccactagccggggacgcagctcaggccccctacccccaacacaaacacttctctcctgtagaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaa

SEQ ID NO: 2103 - DNA, 1692 bp, Homo sapiens
gcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaagctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggaggga

SEQ ID NO: 2104 - DNA, 1591 bp, Homo sapiens
aagagcgccacgggcggggcggggccggcggcgggctgcgggcgcggccggacgggagttccccggagaaggatcctgcagcccgagtcccgtcctcaggcttccccaatccaggggactcggcgccgggacgctgctatggacgacattttcactcagtgccgggagggcaacgcagtcgccgttcgcctgtggctggacaacacggagaacgacctcaaccagggctattgcagtacaaggcagacatcaatgcagtgaatgaacacgggaatgtgcccctgcactatgcctgtttttggggccaagatcaagtggcagaggacctggtggcaaatggggcccttgtcagcatctgtaacaagtatggagagatgcctgtggacaaagccaaggcacccctgagagagcttctccgagagcgggcagagaagatgggccagaatctcaaccgtattccatacaaggacacattctggaaggggaccacccgcactcggccccgaaatggaaccctgaacaaacactctggcattgacttcaaacagcttaacttcctgacgaagctcaacgagaatcactctggagagctatggaagggccgctggcagggcaatgacattgtcgtgaaggtgctgaaggttcgagactggagtacaaggaagagcagggacttcaatgaagagtgtccccggctcaggattttctcgcatccaaatgtgctcccagtgctaggtgcctgccagtctccacctgctcctcatcctactctcatcacacactggatgccgtatggatccctctacaatgtactacatgaaggcaccaatttcgtcgtggaccagagccaggctgtgaagtttgctttggacatggcaaggggcatggccttcctacacacactagagcccctcatcccacgacatgcactcaatagccgtagtgtaatgattgatgaggacatgactgcccgaattagcatggctgatgtcaagttctctttccaatgtcctggtcgcatgtatgcacctgcctgggtagcccccgaagctctgcagaagaagcctgaagacacaaacagacgctcagcagacatgtggagttttgcagtgcttctgtgggaactggtgacacgggaggtaccctttgctgacctctccaatatggagattggaatgaaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaac

SEQ ID NO: 2105 - DNA, 3579 bp, Homo sapiens
tgctcggtggcgccgctgccctggcagagctcgccactccttagtcgaggcaagacgtgcgcccgagccccgccgaaccgaggccacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataaggacgtgtgtaaatatgtacatttgtctttttataaaaagtaaattgtttataaggggtgtggcctttttagagagaaatttaacttgtagatgattttactttttatggaaacactgatggacttattattggcatcccgcctgaacttgactttggggtgaacagggacatgcatctattataaaatcctttcggccaggcgcggtggctcacacctgtaatcccagcactttgggaggccgagatgggtggatcacctgaggtcaggagttcgagaccagcctggtgaaactccatttctactaaaaatgcaaaaattagctgggcgtggttgcgggtgcttgtaatcccagctactcaggaggctgaggcaagagaatcgcttgaacctgggaggtggaggttgcagtgagccgagaacatgccattgcactccagcccgggcaccaaaaaaaaaaaaaaaaaaaaaaacctttcatttggccgggcatggtggcttatgcctgtaatcctggcactttgggaggccaaggtgggcagatcacctgaggtcaggagtttgagaccagcctggccaacatggtgaaacctcatctctactaaaaatacaaaaattaggccgggcacggtggctcacgcctgtaatcccagcactttgggaggcagaggcgggcggatcacgaggtcaggagatcaagaccatcctggctaacacggtgaaaccccgtctctactaaaaatataaaaaattagccgggcctagtggcgggtgcctgtagtcccagctactcgggaggctgaggcaggagaatggcatgaaccccggaggcagagcttgcagtgagccgagattgcaccactgcactacagcctgggcgacagagcgagactccgtctcaaaaaaaaaaaaaaaaattagccgggcctggtggcgggcgcctgtaatcccagctactgtggaggctgaagcacaagaatcacttgaacccgggagatggaggttgcagtgagctgagactgtgccactgcactccagcctgggtgacaagagtgagactttgtctcaaaaaaaaaaaaatccttttgtttatgttcacatagacaatggcagaaggaggggacattcctgtcataggaacatgcttatataaacatagtcacctgtccttgactatcaccagggctgtcagttgattctgggctcctggggcccaaggagtgttaagttttgaggcatgtgccataggtgatgtgtcctgctaacacacagatgctgctccaaaaagtcagttgatatgacacagtcacagacagaacagtcagcagcccaagaaaggtcctcacggctgctgtgctgggtagcacttgccatccagtttctagagtgatgaaatgctctgtctgtaccgttcaatacagtaggcactggcactagccacatgtgccagctaagcacttgaaatgtggccagtgcaataaggaattgaacttttaattgcatttaataaactgtatgtaaatagtca

SEQ ID NO: 2106 - DNA, 2032 bp, Homo sapiens
gccgtgccggggaccgagtgtcagcccacgcgtgggcgcccagtgctcccggctttcggcggtcccagctccgcgcccaggcgacaggttttgggctccctgtgctggtggcaagggctggcttactgcccaggtggctggagggaatcgtgacctacggagactgcgggaagaggcgccacagccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctccccgactggcacatcccagtggaagttgtgccggacagcaccagtgatctgtacaacttccaggtgtcacccatgccctccacctctgaagctacaacagatgaggatgaggaagggaaattacctgaggacatcatgaagctcttggagcagtcggagtggcagccaacaaacgtggatgggaaggggtacctactcaatgaacctggagtccagcccacctctgtctatggagactttagctgtaaggaggagccagaaattgacagcccagggggggatattgggctgagtctacagcgtgtcttcacagatctgaagaacatggatgccacctggctggacagcctgctgaccccagtccggttgccctccatccaggccattccctgtgcaccgtagcagggcccctgggcccctcttattcctctaggcaagcaggacctggcatcatggtggatatggtgcagagaagctggacttctgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggctggctctgcactaagagaaaattgcactaaatgaatctcgttcccaaagaactacccccttttcagctgagccctggggactgttccaaagccagtgaaatgtgaaggaaagtggggtccttcggggcgatgctccctcagcctcagaggagctctaccctgctccctgctttggctgaggggcttgggaaaaaaacttggcactttttcgtgtggatcttgccacatttctgatcagaggtgtacactaacatttcccccgagctcttggcctttgcatttatttatacagtgccttgctcggcgcccaccaccccctcaagccccagcagccctcaacaggcccagggagggaagtgtgagcgccttggtatgacttaaaattggaaatgtcatctaaccattaagtcatgtgtgaacacataaggacgtgtgtaaatatgtacatttgtctttttataaaaagtaaattgttta

SEQ ID NO: 2107 - DNA, 885 bp, Homo sapiens
cgcagatctgcgtgcgcgcagccgccaggggcctgtaggtggcccgctatgttcgtcccgcgcatccacacgccgtgccggggaccgagtgtcagcccacgcgtgggcgcccagtgctcccggctttcggcggtcccagctccgcgcccaggcgacaggttttgggctccctgtgctggtggcaagggctggcttactgcccaggtggctggagggaatcgtgacctacggagactgcgggaagaggcgccacaggtgttccttgggccacttctccagaggaggggaaaccgggccggaaggccaacatgcccatcactcggatgcgcatgagaccctggctagagatgcagattaattccaaccaaatcccggggctcatctggattaataaagaggagatgatcttccagatcccatggaagcatgctgccaagcatggctgggacatcaacaaggatgcctgtttgttccggagctgggccattcacacaggccgatacaaagcaggggaaaaggagccagatcccaagacgtggaaggccaactttcgctgtgccatgaactccctgccagatatcgaggaggtgaaagaccagagcaggaacaagggcagctcagctgtgcgagtgtaccggatgcttccacctctcaccaagaaccagagaaaagaaagaaagtcgaagtccagccgagatgctaagagcaaggccaagaggaagtcatgtggggattccagccctgataccttctctgatggactcagcagctccactctgcctgatgaccacagcagctacacagttccaggctacatgcaggacttggaggtggagcaggccctgactccagcactgtcgccatgtgctgtcagcagcactctcc

SEQ ID NO: 2108 - DNA, 5331 bp, Homo sapiens
acctcgcactctcagtttcaccgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctcccgaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgttatgga

SEQ ID NO: 2109 - DNA, 5305 bp, Homo sapiens
agtttcaccgctcgatcttgggacccaccgctgccctcagctccgagtccagggcgagggcagcgcaggcgggcggaggaccccgggcgcgggcgcggacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggagccaagcagctcaccctggaggacccgcagatgtccatgagccacccctacaccatgacaacgccttacccttcgctcccagcccaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggttgccaggtgacaggaaccttttatgcttgtgccccacctgagtcccaggctcccggagtccccacagagccaagcataaggtctgccgaagccttggcgttctcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcagagctgcaagcgtttgctcaccacggccgctccctgccaagattccaggtgactctatgctttggagaggagtttccagaccctcagaggcaaagaaagctcatcacagctcacgtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctcccgaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgtta

SEQ ID NO: 2110 - DNA, 2749 bp, Homo sapiens
gtccagctgcgcctggaaagcgagctcggacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacagactcagctgtttctttccttttactactaccagttgctcccatgctgctccaccaggccctgtttcggatgccaactggcccactccccaagcacttgcccccagcttgcgaccattggcactgggagggcctggcttctgggctgatgggtcagttgggccttcataaacactcacctggctggctttgccttccaggaggaagctggctgaagcaagggtgtggaattttaaatgtgtgcacagtctggaaaactgtcagaatcagttttcccataaaagggtgggctagcattgcagctgcatttgggaccattcaaatctgtcactctcttgtgtatattcctgtgctattaaatatatcagggcagtgcatgtaaatcatcctgatatatttaatatatttattatattgtcccccgaggtggggacagtgagtgagttctcttagtccccccagagctggttgttaaagagcctggcacctacccgctctcacttcatctgtgtcatctctgcacactccagcccactttctgccttcagccattgagtggaagctgccccaggcccttaccaggtgcagatgcccaatcttgatgcccagccatcagaactgtgagccaaataaacctttttctgt

SEQ ID NO: 2111 - DNA, 1680 bp, Homo sapiens
gcccggcaggttggcggaccggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacg

SEQ ID NO: 2112 - DNA, 2786 bp, Homo sapiens
gcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacagactcagctgtttctttccttttactactaccagttgctcccatgctgctccaccaggccctgtttcggatgccaactggcccactccccaagcacttgcccccagcttgcgaccattggcactgggagggcctggcttctgggctgatgggtcagttgggccttcataaacactcacctggctggctttgccttccaggaggaagctggctgaagcaagggtgtggaattttaaatgtgtgcacagtctggaaaactgtcagaatcagttttcccataaaagggtgggctagcattgcagctgcatttgggaccattcaaatctgtcactctcttgtgtatattcctgtgctattaaatatatcagggcagtgcatgtaaatcatcctgatatatttaatatatttattatattgtcccccgaggtggggacagtgagtgagttctcttagtccccccagagctggttgttaaagagcctggcacctacccgctctcacttcatctgtgtcatctctgcacactccagcccactttctgccttcagccattgagtggaagctgccccaggcccttaccaggtgcagatgcccaatcttgatgcccagccatcagaactgtgagccaaataaacctttttctgtataaa

SEQ ID NO: 2113 - DNA, 2077 bp, Homo sapiens
agctcagaggcggcactaggcaggtgcaaccccaaaagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagaggatgtcaagtggccgcccactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgtt

SEQ ID NO: 2114 - DNA, 2796 bp, Homo sapiens
gcccggcaggttggcggaccggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacagactcagctgtttctttccttttactactaccagttgctcccatgctgctccaccaggccctgtttcggatgccaactggcccactccccaagcacttgcccccagcttgcgaccattggcactgggagggcctggcttctgggctgatgggtcagttgggccttcataaacactcacctggctggctttgccttccaggaggaagctggctgaagcaagggtgtggaattttaaatgtgtgcacagtctggaaaactgtcagaatcagttttcccataaaagggtgggctagcattgcagctgcatttgggaccattcaaatctgtcactctcttgtgtatattcctgtgctattaaatatatcagggcagtgcatgtaaatcatcctgatatatttaatatatttattatattgtcccccgaggtggggacagtgagtgagttctcttagtccccccagagctggttgttaaagagcctggcacctacccgctctcacttcatctgtgtcatctctgcacactccagcccactttctgccttcagccattgagtggaagctgccccaggcccttaccaggtgcagatgcccaatcttgatgcccagccatcagaactgtgagccaaataaacctttttctgt

SEQ ID NO: 2115 - DNA, 514 bp, Homo sapiens
gtccagctgcgcctggaaagcgagctcggacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagatgcagtgcagtctggcccccacatga

SEQ ID NO: 2116 - DNA, 553 bp, Homo sapiens
agcctgggcagagctcagcttggtcccgccgcccggccggtgctccctggcgcagccacgcaggcgcaccgcagacagccttcctaacaggctccggcaggcgttagggccttcctaagtgctacccgaatgcgtgtccagtgggaggagaagggggaggaccaagaacctagatgaatggccctagagaggtaacatctgtttggtgcctgctgtcattggagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacggg

SEQ ID NO: 2117 - DNA, 560 bp, Homo sapiens
attaaacagccgtgttgggcagggccagactgctggactgacagtagggggcaggcagccggaccctctgagctccccaacggcaccagcgcctgcacggcctcagcccagggggtcattagggaagctctccccgattctgtgcagacagagcttcctctgtccacccttgctcggccagaattgtgtgccgctggtgactggcacccctctattctagggccaaggcctctcaggggtctacagatacaactatggccttcctaacaggctccggcaggcgttagggccttcctaagtgctacccgaatgcgtgtccagtgggaggagaagggggaggaccaagaacctagatgaatggccctagagagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggag

SEQ ID NO: 2118 - DNA, 2282 bp, Homo sapiens
agaaagcggaactgagcccgcgtgttctgaggccagggcagggctggagcgttctgaacacctccccgtcccagcccctgggccaggcaagggccggccttacctctcctgggttggtggcagcagagctgggctctgagggaggcctgcaatgtgagacagtagcagctcagaggcggcactaggcaggtgcaaccccaaaagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacaga

SEQ ID NO: 2119 - DNA, 637 bp, Homo sapiens
cgggaggcgcagcctgggcagagctcagcttggtcccgccgcccggccggtgctccctggcgcagccacgcaggcgcaccgcagacagccttcctaacaggctccggcaggcgttagggccttcctaagtgctacccgaatgcgtgtccagtgggaggagaagggggaggaccaagaacctagatgaatggccctagagagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggaga

SEQ ID NO: 2120 - DNA, 689 bp, Homo sapiens
ctcatttgtgtgcagccccggaggaccagagtggggaagcaccccaccctctcccagggcccaactgagcactgcagcgggaggtacggggttgtcaaatgacagttttgccattccagattgccaaaagagccagtggccagtctagggcaccgcgccgtctggcatctccctggaggccctgggcctggcccgaggctcagcccggatctgcagttgccagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagaggtgagtgt

SEQ ID NO: 2121 - DNA, 1374 bp, Homo sapiens
gcccggcaggttggcggaccggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagtgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacg

SEQ ID NO: 2122 - DNA, 876 bp, Homo sapiens
agaacctagagcccaaggttcagagtcacccatctcagcaagcccagaagtatctgcaatatctacgatggcctcgccctttgctttactgatggtcctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacatctggtccaacatgaaaacaattcttattgactcatacaccaggtcacgctttcatgaattctgtcatttcaaagactctcacccctgctataactatgaccatgctgataaactgatttatctatttaaatatttatttaactattcataagatttaaattatttttgttcatataacgtcatgtgcacctttacactgtggttagtgtaataaaacatgttccttatatttactc

SEQ ID NO: 2123 - DNA, 1218 bp, Homo sapiens
gtgcagcacattgttctgatcatctgaagatcagctattagaagagaaagatcagttaagtcctttggacctgatcagcttgatacaagaactactgatttcaacttctttggcttaattctctcggaaacgatgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccagtaatggttgtcctgcctgcaatatttgaattttaaatctaaatctatttattaatatttaacattatttatatggggaatatatttttagactcatcaatcaaataagtatttataatagcaacttttgtgtaatgaaaatgaatatctattaatatatgtattatttataattcctatatcctgtgactgtctcacttaatcctttgttttctgactaattaggcaaggctatgtgattacaaggctttatctcaggggccaactaggcagccaacctaagcaagatcccatgggttgtgtgtttatttcacttgatgatacaatgaacacttataagtgaagtgatactatccagttactgccggtttgaaaatatgcctgcaatctgagccagtgctttaatggcatgtcagacagaacttgaatgtgtcaggtgaccctgatgaaaacatagcatctcaggagatttcatgcctggtgcttccaaatattgttgacaactgtgactgtacccaaatggaaagtaactcatttgttaaaattatcaatatctaatatatatgaataaagtgtaagttcacaacta

SEQ ID NO: 2124 - DNA, 1810 bp, Homo sapiens
agctccaccctgggagggactgtggcccaggtactgcccgggtgctactttatgggcagcagctcagttgagttagagtctggaagacctcagaagacctcctgtcctatgaggccctccccatggctttagctgacttgtatgaagaaggaggtggaggaggaggagaaggtgaagacaatgctgactcaaaggagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgccta

SEQ ID NO: 2125 - DNA, 1747 bp, Homo sapiens
agctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgccta

SEQ ID NO: 2126 - DNA, 848 bp, Homo sapiens
atttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagccctt

SEQ ID NO: 2127 - DNA, 1922 bp, Homo sapiens
gggcagctccaccctgggagggactgtggcccaggtactgcccgggtgctactttatgggcagcagctcagttgagttagagtctggaagacctcagaagacctcctgtcctatgaggccctccccatggctttagggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgccta

SEQ ID NO: 2128 - DNA, 4907 bp, Homo sapiens
tagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 2129 - DNA, 5143 bp, Homo sapiens
gccggagccgactcggagcgcgcggcgccggccgggaggagccggagagcggccgggccgggcggtgggggcgccggcctgccccgcgcgccccagggagcggcaggaatgtgacaatcgcgcgcccgcgcaccgaagcactcctcgctcggctcctagggctctcgcccctctgagctgagccgggttccgcccggggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 2130 - DNA, 709 bp, Homo sapiens
gtgactccctcctgagaagctggaccccttggtaaaagacaaggccttctccaagacttaaaacacacttcacgcagtcacagaaagagctcatagaccagactgcggggcttcaaagccttctatcttatttaatcatctgtaaatagtttaaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcg

SEQ ID NO: 2131 - DNA, 577 bp, Homo sapiens
agtcggagagagcccctggccaggcaccaagctccagaggtcgctctggcgagcgtttgcttcgggatctgatgccctggagtcgccaactcaattcgcgggtcgcagccaggctccatgggggtagtagagccaggtcgtagtggctaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtgga

SEQ ID NO: 2132 - DNA, 549 bp, Homo sapiens
cttcttggaggatggcccatgaagacctccaaacaagctggaggggccagtcacttgctgaagactagcgaagtggagggggaaagcccgagggagctgcagactcgaccactgcgccctcccctcctctccctgcaaggagcccaaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcaga

SEQ ID NO: 2133 - DNA, 609 bp, Homo sapiens
gaaacatttaccagatgtgtggcttgagtgtccattcccgcaacaaaaacgctctgcagtaaagctccgagatggctgtgtttgtgttggactgctctagatgcacaaccctcctggacaaagcgtttttcctcagccttcaccacccatggaggaggtgtgattacctctattcacagaaaggagactgggacccaaccaaggcaagtcatttgcttcagaccacagagcaaagaatcattctgtcattccagaaatatttgtcaggcgcccctggtgtgtcaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaac

SEQ ID NO: 2134 - DNA, 1631 bp, Homo sapiens
accaatactcttttcccctttcctttaacttgattgtgaaatcaggtattcaacagagaaatttctcagcctcctacttctgcttttgaaagccataaaaacagcgagggagaaactggcagataccaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaagaaaaaaaaa

SEQ ID NO: 2135 - DNA, 580 bp, Homo sapiens
actttaatcttccttacaactaggtgctaagggagtctctctgtctctctgcctctttgtgtgtatgcatattctctctctctctctctttctttctctgtctctccctctccttccctctctgcctccctctctcagctttttgcaaaaatgccaggtgtaatataatgcttatgactcgggaaatattctgggaatggatactgcttatctaacagctgacaccctaaaggtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgag

SEQ ID NO: 2136 - DNA, 581 bp, Homo sapiens
gaaagccataaaaacagcgagggagaaactggcagataccaaacctcttcgaggcacaaggcacaacaggctgctctgggattctcttcagccaatcttcattgctcaagtatgactttaatcttccttacaactaggtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaa

SEQ ID NO: 2137 - DNA, 581 bp, Homo sapiens
aatacattgctagttggggtttggtttagcaaatgcttttctctagacccaaaggacttctctttcacacattcattcatttactcagagatcatttctttgcatgactgccatgcactggatgctgagagaaatcacacatgaacgtagccgtcatggggaagtcactcattttctcctttttacacaggtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgc

SEQ ID NO: 2138 - DNA, 1522 bp, Homo sapiens
acggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaatt

SEQ ID NO: 2139 - DNA, 1283 bp, Homo sapiens
cgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtga

SEQ ID NO: 2140 - DNA, 863 bp, Homo sapiens
cgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattac

SEQ ID NO: 2141 - DNA, 2472 bp, Homo sapiens
actccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggaggtacagagctcggcttctttgccttgggaggggagtggtggtggttgaaagggcgatggaattttccccgaaagcctacgcccagggcccctcccagctccagcgttaccctccggtctatcctactggccgagctgccccgccttctcatggggaaaacttagccgcaacttcaatttttggtttttcctttaatgacacttctgaggctctcctagccatcctcccgcttccggaggagcgcagatcgcaggtccctttgcccctggcgtgcgactccctactgcgctgcgctcttacggcgttccaggctgctggctagcgcaaggcgggccgggcaccccgcgctccgctgggagggtgagggacgcgcgtctggcggccccagccaagctgcgggtttctgagaagacgctgtcccgcagccctgagggctgagttctgcacccagtcaagctcaggaaggccaagaaaagaatccattccaatatatggccatgtggctctttggagcaatgttccatcatgttccatgctgctgacgtcacatggagcacagaaatcaatgttagcagatagccagcccatacaagatcgtattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggcatataatgtccatcagtaaatcttggtggtggtggcaataataaacttctactgataggtagaatggtgtgcaagcttgtccaatcacggattgcaggccacatgcggcccaggacaactttgaatgtggcccaacacaaattcataaactttcatacatctcgtttttagctcatcagctatcattagcggtagtgtatttaaagtgtggcccaagacaattcttcttattccaatgtggcccagggaaatcaaaagattggatgcccctggtatagaaaactaatagtgacagtgttcatatttcatgctttcccaaatacaggtattttattttcacattctttttgccatgtttatataataataaagaaaaaccctgttgatttgttggagccattgttatctgacagaaaataattgtttatattttttgcactacactgtctaaaattagcaagctctcttctaatggaactgtaagaaagatgaaatatttttgttttattataaatttatttcaccttaa

SEQ ID NO: 2142 - DNA, 1447 bp, Homo sapiens
gggactccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgacgtcacatggagcacagaaatcaatgttagcagatagccagcccatacaagatcgtattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaa

SEQ ID NO: 2143 - DNA, 1018 bp, Homo sapiens
atggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggc

SEQ ID NO: 2144 - DNA, 6026 bp, Homo sapiens
catttgatgtgtccatcattcccttttgctggatatacttcccttgactgacttctagaatatgatactcttcattttccccttattcagtagtcattccttttgatttttctttcctggtccttcttttataatccttgacctaattaatactgaagtatcccatgctcaggttttggtccttttctctacctacatcactccctcatgagcactctgatgagttgcatatctatttccagttcagacacattcctgaactcgagatttatgtatccaatggcatatttgatatttccttgtgcatatctaatgagcctttcaaactcagcatgtccagaactgaaactcctgacctgtcccctctcctcaaggcatcagctgtgtccaaggcttgcttttttcagttgatgtcagctccatcttctcaggtgttcagaggaaaagactcagagtcattctcattctctttttcctcctgtaccctgcaatctgtctggaaattatattagtcctatcataaaaaatgattccagactctaaccacatgtatctatctccactgctaccccaagcagattcaggtcctcctctcctccacctttctgacctcatctcagactactcttgcccttgctcattccactggcttcttttctgtcccttagactcatagccacacagttgcctctgccctagctattccctctgcttcaaatagtcttcactgagataccaccggggctcacaccctttctatctttaccctgactacccaaaatttcaacctcacccttcttaccttgtttcctttttcctagataatttttcactctctaataaaatacataattataataacttatttgtgcattttctatatggttcatctttctttctgaaatcaagattgtgttctgccatcattgatgtattccaaggtcataaaaaatgcctagcccataataaatattcagtgaatatttactaaatgaatcaaggaaagtgatgttgtcttatagtctctatattctattcagtctcggcttgtcttttctagtggtttgaatgaatggatgatgcatttaacccagaaaaccaatacttgtaaatcttttattcttgtatgtttaattaattttaaatgtgtgattagacaagttaataagcagaacaaaacatcaagtatgttagatcatctttcctcactgggaagaactataatattggtatagaatgtaagatgtttacagttattttcacaagcaatgatttgcttgggaaatagcaatggtgtgagccccgacagtatctgggtgaagaatatttgaagcagaaggaaaatctagagcagaggcaactgtgtgactacgagtctaagggacagttttcactccagaatgaaaactatagagatgcctgcctgcgttaacttgctcacctcactatgtattttccctgggcagtaccatcctgctaggatttcagtgctgccatgagtcagcagtcaccttgcagtgagatccaatcacaagattccaaacaattcctaccctgtgagctccttgaggacagggctgggatttagtctcttttatttcacaggcccagagttctaggatggcagaatggtttcgggtgccaggccccacctggttgctctccatgggcatactgcccagggctgccttgggacttggctccctacattttggtgcagcagtcttcagccaccccaactatggcttaagtggccccagctgcagcttgacccactgcttcacaagatacaggtggtaagccttggtgaaattcatgtagtgttaagcctgcagtctcacagaatacaagagctgagggggcatggcttcctccactttgatttcaaaagatgatgctgacttatttggggcacaggcagagactttgcacaggggtagaaccaccacagagagcccccaacagggcggtgcctcatggagccaaggaaatggggttgccaccaaaatcctagaattatggttaacagtgtagagctgcagtctggaaaagcttcaggcatgagactccaacccatgacagctgaagaataggctgagcctaggaaagctatgggagctgagctgcctgaggccttaggggtccaacccccacccagtgtgcccaggatgcagaatatggagtgaaaggaaattattctccaactttaagatttaatattgttctccctgttgggttttggacttgtttcagatgagttatccctcttttcttgcctatttccccattttagaatgggaatgtctcttctataccttcgcacattgtattttggaagcagatagcttattttgatttcacaggctcgtggttgcagaacatttgccttcaggatgaagtcacacccatatttgatttagataagtattacctagataactcgattaactagatttagataagtattaactaacagtattaagagttaatactggagtgacttttgagcctactaggatggaatgaatatattttgcattgtatgaaggatgtgaatttggcagagaggggagggtaggtgcagaatgctatggtttgaatgcctccaccaaaactcatgttgacatttaattgtgaatgtgacagttttaagaagtgggatctttaacaggtaattaggtatctctttaggcactttcattagacagggccctcatgaatggattaatgcagttatggagggagtgagtttgttattgcatgagtgggctccttattaaagggtgattttggctcagtttcctctctgtctcatgtgcttgctttcacttctacccttctgccacaggatgacccttagcagatgtcagtgccatgcacttgtacttcccagcctccagaactgtgagccaaatgagcttgtgtcccttgtaaattaagtttgtggtgttctcttatagcagcagaaaatggattcaggcagcaagcagagctataaaatacttctttttttttttttttgagatggagtttcacttttgttgcccaggctgtagtgcaaaggcatgatctcggctcaccacaacctctttctcccgggttcaagcaattgtctggcctcagcctcccgagtagctgggattacaggcatgcactatcacacccggctgattttgtatttttttgtaaagacggggtttcaccatgttggtcaggctgatctcaaactcccgacatcaggtgatcctcctgcctcggcctcccaaactgctgggattacaggcacgagccaccatgccctgccaatacttcttttcatctacactggcttccattatcatgattttgttagatacttttgaggacattttctattgcattcctccatgtttggcaaccacactctatggtggagtcttctggctaagcacttagtcttcttttacttataccagcaggatgtagttgagcagggtagtgaaaatccattgtgacattgtaaagcctcactgctataagaggccaggaatgaaattttcattgtttacaaaagtagcttcgtaaggcctaattaagaattatatcacccatggcattgctcaatcccaagtcaatattttttttttttgaaaaatgtggattcaaggataccacaactaaaagggatgtagggaatttaagaggctttggatgaaatgatgaagattacggtaaagttttataaaaaatttgaagcactgagataatatagacaaagggaataattataaaatgagagtgataaggaaggtttgctttaaataaaccaatcaatgagtgatttagatcatatgtaacaggaatattagatttgatatgttcttgtggacaaaaaggtatttctattggatacacctttgtatcttgcttaatacctaaataagtgttagctttttctttctatgagttatagacaatacattttaaagcagccattttttatatttcagaaacatctgaaaagtataataatttaattctttgtgtttatggaacttaattcagtgaatatttatgtcatgggttgtggcagattttggttttttgtggaagaggtcaccatgtatatactattttgaagggcagaaaatagttgtttctatttttgtatattttggttataaactgcttttaatggcatggagttgaatttagggatgtttaatcttcatattcttcacttgatttgagtgagaaaaaataaaattttcttggttataaaattctcaaatgattaacaatggtttctttaaaagactgaagatacatattcagtggctgtagaaatggctactgctattgtaaactggattaacaatcagtacttctacaaatctaagtatttgtttgtttttactttttactagtatgactctggaatttttcaattcagggaaataatagaatagaaaagctttgctaaggcattgtaatcagacagaactggcctcaaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctccctttctttttcttactagtgcacttgtgtttttaatggatcatactttaccctagattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggc

SEQ ID NO: 2145 - DNA, 1388 bp, Homo sapiens
cctgcagccaggactcgatggagaatccattccaatatatggccatgtggctctttggagcaatgttccatcatgttccatgctgctgacgtcacatggagcacagaaatcaatgttagcagatagccagcccatacaagatcgttttcaactagtggccccactgtgtccggaattgatgggttcttggtctcactgacttcaagaatgaagccgcggaccctcgcggtgagtgttacagctcttaaggtggcgcatctggagtttgttccttctgatgttcggatgtgttcggagtttcttccttctggtgggttcgtggtctcgctggctcaggagtgaagctacagaccttcgcggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgc

SEQ ID NO: 2146 - DNA, 1355 bp, Homo sapiens
cacttctgaggctctcctagccatcctcccgcttccggaggagcgcagatcgcaggtccctttgcccctggcgtgcgactccctactgcgctgcgctcttacggcgttccaggctgctggctagcgcaaggcgggccgggcaccccgcgctccgctgggagggtgagggacgcgcgtctggcggccccagccaagctgcgggtttctgagaagacgctgtcccgcagccctgagggctgagttctgcacccagtcaagctcaggaaggccaagaaaagtttcaactagtggccccactgtgtccggaattgatgggttcttggtctcactgacttcaagaatgaagccgcggaccctcgcggtgagtgttacagctcttaaggtggcgcatctggagtttgttccttctgatgttcggatgtgttcggagtttcttccttctggtgggttcgtggtctcgctggctcaggagtgaagctacagaccttcgcgattgtattgtaggaggcattgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttg

SEQ ID NO: 2147 - DNA, 1147 bp, Homo sapiens
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtgaa

SEQ ID NO: 2148 - DNA, 1090 bp, Homo sapiens
gcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtg

SEQ ID NO: 2149 - DNA, 795 bp, Homo sapiens
gctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcagatggctctttgctttcattaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactag

SEQ ID NO: 2150 - DNA, 1029 bp, Homo sapiens
ctatcacctaagtgtgggctaatgtaacaaagagggatttcacctacatccattcagtcagtctttgggggtttaaagaaattccaaagagtcatcagaagaggaaaaatgaaggtaatgttttttcagacaggtaaagtctttgaaaatatgtgtaatatgtaaaacattttgacacccccataatatttttccagaattaacagtataaattgcatctcttgttcaagagttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttgataattaagtgcttcccacttaaaacatatcaggccttctatttatttaaatatttaaattttatatttattgttgaatgtatggtttgctacctattgtaactattattcttaatcttaaaactataaatatggatcttttatgattctttttgtaagccctaggggctctaaaatggtttcacttatttatcccaaaatatttattattatgttgaatgttaaatatagtatctatgtagattggttagtaaaactatttaataaatttgataaatataaa

SEQ ID NO: 2151 - DNA, 616 bp, Homo sapiens
tgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatct

SEQ ID NO: 2152 - DNA, 414 bp, Homo sapiens
atgggtctcacctcccaactgcttccccctctgttcttcctgctagcatgtgccggcaactttgtccacggacacaagtgcgatatcaccttacaggagatcatcaaaactttgaacagcctcacagagcagaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagctga

SEQ ID NO: 2153 - DNA, 1170 bp, Homo sapiens
aatattagagtctcaacccccaataaatataggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcatttt

SEQ ID NO: 2154 - DNA, 539 bp, Homo sapiens
aatattagagtctcaacccccaataaatataggactggagatgtctgaggctcattctgccctcgagcccaccgggaacgaaagagaagctctatctcccctccaggagcccagctatgaactccttctccacaaacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattg

SEQ ID NO: 2155 - DNA, 1527 bp, Homo sapiens
aggtaacaccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaa

SEQ ID NO: 2156 - DNA, 649 bp, Homo sapiens
atctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattgttattgttaaat

SEQ ID NO: 2157 - DNA, 1493 bp, Homo sapiens
attctgccctcgagcccaccgggaacgaaagagaagctctatctcccctccaggagcccagctatgaactccttctccacaagtaagtgcaggaaatccttagccctggaactgccagcggcggtcgagccctgtgtgagggaggggtgtgtggcccagggagggctggcgggcggccagcagcagaggcaggctcccagctgtgctgtcagctcacccctgcgctcgctcccctccggcacaggcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggtgggtgtgtcctcattccctcaacttggtgtgggggaagacaggctcaaagacagtgtcctggacaactcagggatgcaatgccacttccaaaagagaaggctacacgtaaacaaaagagtctgagaaatagtttctgattgttattgttaaatctttttttgtttgtttggttggttggctctcttctgcaaaggacatcaataactgtattttaaactatatattaactgaggtggattttaacatcaatttttaatagtgcaagagatttaaaaccaaaggcgggggggcgggcagaaaaaagtgcatccaactccagccagtgatccacagaaacaaagaccaaggagcacaaaatgattttaagattttagtcattgccaagtgacattcttctcactgtggttgtttcaattctttttcctaccttttaccagagagttagttcagagaaatggtcagagactcaagggtggaaagaggtaccaaaggctttggccaccagtagctggctattcagacagcagggagtagacttgctggctagcatgtggaggagccaaagctcaataagaaggggcctagaatgaaacccttggtgctgatcctgcctctgccatttctacttaagccagggtttctcatatgttaacatgcatgggaattccctgggcatcttcttgtggtgtggagtctgacttagcaagcctcgggtgggtttgagggtcaaatttctaccaggcttatatccctggtgatgctgcagaattccaggaccacacttggaggtttaa

SEQ ID NO: 2158 - DNA, 574 bp, Homo sapiens
aatattagagtctcaacccccaataaatataggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagtt

SEQ ID NO: 2159 - DNA, 1705 bp, Homo sapiens
gagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 2160 - DNA, 3666 bp, Homo sapiens
gcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcggg

SEQ ID NO: 2161 - DNA, 3432 bp, Homo sapiens
atggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgc

SEQ ID NO: 2162 - DNA, 2049 bp, Homo sapiens
atggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctga

SEQ ID NO: 2163 - DNA, 2127 bp, Homo sapiens
atggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctga

SEQ ID NO: 2164 - DNA, 3319 bp, Homo sapiens
cccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaat

SEQ ID NO: 2165 - DNA, 2382 bp, Homo sapiens
ggcggggcctgggaggggacaaagccgggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtaggagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattaccatt

SEQ ID NO: 2166 - DNA, 942 bp, Homo sapiens
ccagcaccagcgaggggaggggaggggaggggcgggcgtggagacctggaaggaggtaccgatccagccttgattgcagccctcttgcacaacggccataaggacgggtgcaggccaagagcaaggacatgcaaaccccaagacctgctaacgggcggcgaagcgggggcacgccctcgcacacgcagagataaattgtgctcccatgacctttatttggaaagtgcctgcgggcctaaaattggcctttgtcccaccgagtacactcagcactgtactttaaaccggataaactgggctgtctggcaggtactaaaaacagctaaattctcctgtgagtgttctgtatgttaacacttttattccttgttttgttttaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacac

SEQ ID NO: 2167 - DNA, 2441 bp, Homo sapiens
aggggaggggaggggcgggcgtggagacctggaaggaggtaccgatccagccttgattgcagccctcttgcacaacggccataaggacgggtgcaggccaagagcaaggacatgcaaaccccaagacctgctaacgggcggcgaagcgggggcacgccctcgcacacgcagagataaattgtgctcccatgacctttatttggaaagtgcctgcgggcctaaaattggcctttgtcccaccgagtacactcagcactgtactttaaaccggataaactgggctgtctggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtaggagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaa

SEQ ID NO: 2168 - DNA, 702 bp, Homo sapiens
cttgagcccaggaagtcaaggctgcagtgagcggtgatcgctccactgcactccagccagggcaacagagcaaggccctgtcttaaaaaagaaaataataagaatcccattcattatcttctaatgcaaacaatcaatggagtttctaaagacctagacataggtggtgtcaggacctgcttctgtaacttttccatcctttgcattaggcagcgcggaaccccctaggcgaccccgcgctggccgggagcactctttcttcagccaaagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgc

SEQ ID NO: 2169 - DNA, 2298 bp, Homo sapiens
agggggcgtggaggggcggagctccagcggccttcagaggggtcgctaggccacacggggcgagagggggctgggggaaacacccccgccagttccgggtgcctggagtttaaaaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtaaaaactatgatggtgacgtgcagtcggactctgtggcccaagggtatggctctctcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtaggagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaatta

SEQ ID NO: 2170 - DNA, 563 bp, Homo sapiens
aagaagccagggggactgcgcgcgtgagcgtcacgcatgcggggtcaacggatgggtgcttggtgctctgggcactgcaggggtgctggctggactgcggttaccgcagcgcggaaccccctaggcgaccccgcgctggccgggagcactctttcttcagccaaagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaa

SEQ ID NO: 2171 - DNA, 2694 bp, Homo sapiens
gtgcccgcgcggccagcgcccgccaggcccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaattgtctgctgtgtttgtccctgaggggaggaggtagtgggaccctgaggcagaggccctgctagagctggcaggttcccctggggcagaccagagcacctcaggaaggggctgccacggcagggaagggaccaggcagccctgggagcccgcattccacaggggcccactgcggagttctcggacactcagggcacaggcctgtgggttccctggaattttctagcatgatccagtttctgtgtccagttctccattctgagagtcaatcagttcctgataggttgtcattgatttttttcttcgttggttttaaccttctaaacatctccaggccactttcttagcctttttctaggtactaaaaagaggtcctacccacacctgcctcacacttctcctttccaaggctgcctgagtttggaggggcttgggtgtgtgtgaacaagggccctgcattgtctaggcctgcagttcccaggcttgggttcactttcaccatgcattggcaaaactagaaaagtaagcttgtgacaaattgttctcggccgggcacagtggcgcacgcctataatccctgtactttgggaggctgaggtgggtggatcacttgaggccaggagttcgagaccagcctggccaacatggtgaaaccccatctctactcaaaatacaaaaattagccaggcgtggtgatgcgcacctgcagtcccagctactcgggaggctgaggcaggaaaatggcttgaacctgggaggcagaggttgcagtgagccgagactgcaccactgcactccagcctgggtgacagagcaagactctgtctcaaaaaaaaaaaaaaaaaaaaaaaaaaaaaaattgctctatgcaagttttttagccccatgtaaaaaggaaaaataaaagttgctctaaagctacatataatcaaaa

SEQ ID NO: 2172 - DNA, 1449 bp, Homo sapiens
agcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcagccgcggcgccactagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctact

SEQ ID NO: 2173 - DNA, 1453 bp, Homo sapiens
aaggaaagaatattttggggctaaaagagccccgtgtctttgctgcctggtaattcctgcacgcatcttttcctattttgcaacgccataggcttccagcgactgctggtgatgtttctgatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaacttccccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccacggacttcctcgacaccatcaagagcaacctggacagagccctgggcaggcagtagggggaggcgccacccatggctgcagtggaggggccagggctgagccggcgggtcctcctgagcgcggcagagggtgagcctcacagccc

SEQ ID NO: 2174 - DNA, 5901 bp, Homo sapiens
cacgcgtcattgtgttacctgcggccggcccgcgagctaggctggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggcc

SEQ ID NO: 2175 - DNA, 3758 bp, Homo sapiens
attgaaacaatccacccggtagagtgaacagcttgaggttgatcctggcctgtgataagagccaggtcagtatacttgttagggacatgtgagagacctccccgccacactgcagcattcacagcacctttcctggacctcctgtcacctcgcaggtcagggagttatgtcccctgggaacccagggcttgtccagagctacccacagttgtctgcatttccaggtagcccgattttggggttctaggatgtttcatctcctgggggggtaatcaaatccctggaagaggacaagaaagactgagaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtacggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatcta

SEQ ID NO: 2176 - DNA, 5285 bp, Homo sapiens
ctgcaggaaggagagaggaagaggagcagaagggggcagcagcggacgccgctaacggcctccctcggcgctgacaggctgggccggcgcccggctcgcttgggtgttcgcgtcgccacttcggcttctcggccggtcgggcccctcggcccgggcttgcggcgcgcgtcggggctgagggctgctgcggcgcagggagaggcctggtcctcgctgccgagggatgtgagtgggagctgagcccacactggagggcccccgagggcccagcctggaggtcgttcagagccgtgcccgtcccggggcttcgcagaccttgacccgccgggtaggagccgcccctgcgggctcgagggcgcgctctggtcgcccgatctgtgtagccggtttcagaagcaggcaacaggaacaagatgtgaactgtttctcttctgcagaaaaagaggctcttcctcctcctcccgcgacggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctggggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtcagttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaattaagtataaggggttgttcgttgttgtcatttgttatagtgctactccactttagacaccatagctaaaataaaatatggtgggttttgtgtgtgtgtgtgtgtgtgtgtgtgtgtgtgtgtgtgtgttatttatacaaaacttaaaatacttgctgttttgattaaaaagaaaatagtttcttacttta

SEQ ID NO: 2177 - DNA, 3535 bp, Homo sapiens
attcggggagactgcaggccaaccgggaggctgagttcgaagctagcagggcggcgaagccagtgtcgcccgcggcgttgagaagacggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctggggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgaga

SEQ ID NO: 2178 - DNA, 3381 bp, Homo sapiens
gagaagctcgactacgactacctgcggaagctctccagctacctcttcgaccgaagcggcttcgtgttcgactctgagtacgaggggctcgggaagcccttggcgacccccatcagcagtgtccacaccgacctgccctcccagcctcagcttcgggacaaagatcagccgcacagcaaaaaccaggcgctgaactccaccaatggggagctgaacgcggacgaccccatggccggccactccagcgcccatcagggcgcctgcagagatggagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctggggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttc

SEQ ID NO: 2179 - DNA, 3125 bp, Homo sapiens
atctctctcgccccctctccctccgtcccgtcctcgccgctcccctcaccccgcctctctccccctcccccagcccctcctctcctcaccccacccggcctccctccctccctcgcccgcccggcgctcgcagagccgacaccaggggggctctcgatgtagcaccatgacaggcatcgccgccgcctccttcttctccaatacctgccgattcgggggctgcggactccacttccccaccctggccgacctcatcgagcacatcgaggacaaccacatcgatacagatccacgggttttagaaaaacaagaattacagcagccaacctatgttgccctgagttacataaatagattcatgacagatgctgcccgccgagagcaggagtccctaaagaagaagattcagccgaagctctcgctgactctgtccagctcagtgtctcgagggaatgtgtccactcccccacgccacagcagtggaagccttactccccccgtgaccccacccatcaccccctcctcttcattccgcagcagcactccgacaggcagcgagtatgacgaggaggaggtggactatgaggagtcggacagcgatgagtcctggaccacagagagtgccatcagctccgaagccatcctcagctccatgtgcatgaatggaggggaagagaagccttttgcctgcccagttcctggatgtaaaaagagatacaagaatgtgaatggcataaagtatcacgctaagaatggtcacagaacacagattcgtgtccgcaaaccattcaagtgtcgctgtgggaagagttacaagacagctcagggcctgcggcaccacacaatcaatttccatcccccggtgtcggctgagattatcaggaagatgcagcaataacatgctggtcataactgtgccaagaaatcctcaccagcagttgctgattttgaaaacagccaccttttttcaggggaagcattcagcaaccctttaaagaaaaagaattaaatgcatgctttaaattttttctgtaattttggaatgatgtatctttgtagagttaatgattttgtacatttgcacatgtaatcatcatacccattttcattactttgatataaggtgctaaacaaaaaaagctctaggttcttcagcacatttcccccaaaacaaaataaaattgagggcatgttgcatattgttgaattgtattgcggtggtatcaacctggggggaggaggggctggcactgagatttttttttcaagattgtaatgtgattgaagttttcaacacatcaactcacatatgttcaaaaccaaaataataccttcattatcaaactggttaccatgccttacataatggagttagtatttgtgagtagaaagactttaggtaatggaaatataaataagaaagaatgtttaacataatatgctaaaaatattttcatatttaaataacatacgtaaaggtgtgctttctgtgttttatattatcttgcaaatccttttgccctttaaaaagctgaaaatcttgccatctgacttactagtcattttagtgttataaatggcattttgtacaaaatagtctattcagttcgttcattcatttaacacacattgattgagtgcctgctgggtacaagggattcaatttatgcctattgatatctgcggaccaagatacccatttagtgaaatacttttttccctgaaatctgttagaaaagactttgaaatacttcagtgcaaagtgtgtgtgtgtgaagtttagttatatcttcatcttcagatgaagttttaaagcactttgtagttctctattgccaacaatttaatgtttatgtgttgccaattcttgcaaccactgccctaccaaacctgtgggttgcaaatcagaactaaaattctaagcacgtttcaaagatgaacacttttgttaagacccctattgcctcttcttcatgctcattttttactttttttaaaaggtacttttctcatcacattgtagagaggtctgcattctcattggaaatgtctgtttagctttataaaacaaacactttgctgaaataggaaaatgagccttattgacaattaagtgcttcttgcagcaggtggtcaaagaaaagcatgactaatacgacctattagagtaatctacatctggaccattccttaagtttttcctcaccgacagtaccatcatgccttgagtgttcttttctcccaagtgctattccttaaacacgagagtttaccagttgcctaataatgcaataaaaaatgctttgagatagctaactgcccataaaacaaactcaaattgcttataaagtttcttcccatgttcccatttgatgaaaagtcttacatcacatataactgggaagcaggggtccctcctcaattttcagacattttgaaaggatgacagttctgtttgttagatgagtaaacctctatattcataagttctaaaatccttcattatgagggattcaaagtatttataaaaacactgccctctaaaaatttcctcagatctgaagtatggtcttggtcctgaatatacagtgttatcctatgtttaaaagggtgatccagacatgagacgcaactagttggtgcataagaaggccccacttggctatttcatatctacctacaattgaccaaaaaaaattttttaggccagcaattattatttagcttcgctctttctagtgcaagaaactgcaggctggatcagtagttcaacagctaaacagtcataaaatagtcattgtgcatgttaaatttctttcaatgctttcaaagataaattccaatttctatttacttattcattgtgacagtattactaaacaggtaaggatgggaatattttgttatactgtgtatagtgaatgtattgtactgtgtctgtgaaaactgtgctttaaattatattttcatatgttttgttggggacagagcacattaagtctgaaagcaacagaggtttgttttagaactgaaggcaatttaatcaaaattcctgtcaagaaaagctgcttataaatgtaaatgaaatcacatttaaaataaactgcctctgacccaaaaataaa

SEQ ID NO: 2180 - DNA, 1815 bp, Homo sapiens
gagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttcttt

SEQ ID NO: 2181 - DNA, 3321 bp, Homo sapiens
gacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagccaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaatacc

SEQ ID NO: 2182 - DNA, 3105 bp, Homo sapiens
catcctgccacccctagccttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacgcagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctccgagctaggctggccctgagtcattagcaccttctctgccttcatgaggccactgaactcaagggacctcaccttgcttctatcccagcctctaagaccagagggccgagggggtagtgaagattgggaaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagtctggccaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttttaatagcacctattatacctgaaatt

SEQ ID NO: 2183 - DNA, 2967 bp, Homo sapiens
accagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctccgagctaggctggccctgagtcattagcaccttctctgccttcatgaggccactgaactcaagggacctcaccttgcttctatcccagcctctaagaccagagggccgagggggtagtgaagattgggaaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagtctggccaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttttaatagcacctattatacctgaaatt

SEQ ID NO: 2184 - DNA, 3006 bp, Homo sapiens
acaatctcccttttcaagccagcctctgtccctcctactcaacctgctttatctctaggccttcctccttcctcttccacagtctggcttctcacattgtcactctagcagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccagtcccaaccttccatccccaacccttagggatgatggaagaatcattttcctcaccctagttccaagtcccaggaaacaccttttaaccacttccttctcatctcccactgtttcccacttctggttccacccaacaccagttcctccgagctaggctggccctgagtcattagcaccttctctgccttcatgaggccactgaactcaagggacctcaccttgcttctatcccagcctctaagaccagagggccgagggggtagtgaagattgggaaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagtctggccaaaatggtgaaatcccatctctactgaaaatacaaaaactagccaggcatggtggcaggcacctataatcccatctacttgggaggctgaggcagaagaatcacttgaacccggggggcagaggttgcagtgagccaagattgcaccattgcactccatccagcctggacaaaagagcaaaactccatctcaaaaaaagaagaagtttgagtgtctcagcttatcctgaactttgaagcagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaaggtctgagcacacagctcccttccgtggcctctttcccattctgcccccattagcacacgcaggaaatgtcagacaggcgtatcagctgggtttgtcatccaaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgtttttttttttaatagcacctattatacctgaaatt

SEQ ID NO: 2185 - DNA, 969 bp, Homo sapiens
tgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaaccccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatcc

SEQ ID NO: 2186 - DNA, 1979 bp, Homo sapiens
gccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtattagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttc

SEQ ID NO: 2187 - DNA, 2197 bp, Homo sapiens
gacacctaggccccgggggtggctctgccaccaagtcgtaggcgagcgtaatgaaagcaaagatagcaaattgtaaggagggctttgacttttgtcatcttctgaatgacgcacagctgatgtcatcctaattaagcgcattcactcctagtctctggaaatgcaaatcaaatatgcgagatgcggcactgcatttttaatgttgaccataatgtaatgatgaagcaaatttttatttaattttcgagtctgcacctattttggccaagtaaagacagtaaaatagggagagcctcctgaggatctgaatttattgccctggcacataatttttagctctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtattagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccaccctt

SEQ ID NO: 2188 - DNA, 3972 bp, Homo sapiens
attaagagcatgctactctgtacttcgctgctgcagaagagagagtgatatttgtgttactacagcatgttgtaaatgtgtgagattttgctcatctcagcttggaaataagaatagggaaaggagagcaacttgaatcagaagctactagaagaacctgcagagttctgaagcagtttatattcttcttacattttgccttctcctagctggaaagcagagggactggaatttttgaaacgggcttttcccataatggcattcttgatttgtgtggccagagcttgcacaggaggaaagcaggctgctgaatttagtcactgatctctattagcggtagcctaaggctatgctgaggtttatatcccatttgtattgttgcagctcaaaagaagattgttcagaggatgacaagtgtattctgagtaggtatgttgttgtttcattttcatatgaaacccatctatgttttttcttgctactattggtcagaaatcaggttaataggtgcagaatatagtacagtgctgcagtatccctgttaaggtagaacaatggtattgcaagcttaaaaaaaaaaagcctggctgcttttattaaataaagctgcattgtatggtatgcacagtgcagtcctaaaaaaatatactgcagtcaacgcttttctggcactattgttgagttggaatgattgaatcatcatattgctttaggggacagaagaatttaaggaggtaccttacagccctattttacagattggaagcatcggtttaagggcactggcagaatcctttgcttgttctccgcggcagccactgctgtgtcagtacagtgtggaatggaagtcttagttggtagtctgttatggaaacgctctttactgttattgtagtaccgtggtgacaacatgccattgaaatggaaaacgagctctcctgctatctggaaattcccagttcctgtgcttaaaacatccaggtcaactccactttctccagcatacatatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 2189 - DNA, 5331 bp, Homo sapiens
cttggaattactcagataatcattcctttaagcatagattgatataattgtggcttggggtttgcagagaagtgttacctccttgcaatgttgaagaacagtgctcttcacattcaatcaataaacttaataaaggggagatagatgggaatattgaatctgctaagaaggttaacatggcatgtactgttaccaaagcagaaattagtagggagtgttttgaatgttaaaaagtcaaaagatactgataaaacatcatgaaaaagataattttagtccaggcttcttcagcttttgaagtaattaattaaaaaggcaagcatattatgttggcaagaaagggctgcattttcactttttgctttctgtttttaagagcaagagacaaatgacaaagtaaataagttgttacttgtagtttactcaaaaaagcaatttccgggatatgtcattgtggcaatgtgaattcagctttactcctatcccttttacatctgcagtttcataagaatgataattgatggtcatttaagcactgcataataaagaaatgtctttggaatgatctacagaaagaagattctgtattcattcagaggacatatattaagtctttcgtgctaggctctgtgcagggaatacagaaactaataaaacagtctgcttgaatatcctattaatataatctggatgaatagacattttctggttagggataacagtcaccatcaatcaatttctgacttttccaattgattctgtaattttaaacgtctgtccacaaaagttgtttaaaattgtgtgtgtgtgctatatatcataaatataacttaattctctttaaagctatctctgaaactctggtggaaggctatatccagtttcttttatgctttttaaaatcttaagttattctcttctttattaaatatctatcagaattgaattaaacatggttatatattattaattcatttttggttatactatggctctaatatcattaagaagaattgatgtcatccttaaggccagaatttttgctaattattgcaagatttaaaaccacttagttggtgtcataattcaaaaagcagaatctttagtatggtctttttcttgttaaaactgatcaacttggggttttaggtatgacaggaaaaaaaggtgaaacctttctgatattggatagctcagttagacagttagaaaagcaaataattcaaaattgaggaaattacagaaaaaatgaagagttccagcacttgaaaatctgctctccttcttttttcctaatgtctattttagcagtctttttagcagtctgtatcatgaatgcagaaccaaattcatgagccatgggctccccactcttaggcaggtgatccagagattattttagcaatgtatacctatggagaaacacaagatctcttctaaggaatgatgaaaggttattaataatggcacatttttagtataacctgagatttttaaactatcaaatgtattgtcatattctctttgcatctaagtgacctactgactaaggttctcctattcttacttatgccccttgaaaatactattgctgcaatacatgcaaatacagaattgcctgtatttatatttttagtattcatttctttgaaaagatggaaatgtgactagattgtagctattaaacaatcccaaactggtaagtgagagatactgctagaaaaagaaattatatcatgtgaaaaattttgttcagttggggttgattagaactactactaataacagaagataaagtaatgcattaatatataacaattaatcttttacttttattaatgggggtttggagtgggaatcagactagacctagattcaaaccctgggccaaccactttaataagtggtttctgacccttctttagtctgtgtataaaattattggcaagtacctgctatataatgactattcaataaatggtagctatcatttttatcttttcaaaattaggtgttccaaattaattttaactatatgcagcataatttgatggcattgctatctaaatagtaacatatcaacagtaattactgtggcctttaaaaactctgtgactataattttgaaccaccttttaagttgatttctcagttatcatctgtatattctgtacttggaaaccattttacaaatatacatttcttctaagataaagagtggtacaagcgtataatatagtgaaacaatattcaccatattgcatggtcatatgattgcaatagtgactgattatttttctaaataatctcattgtaaattgtacaagttttaatttccccttctttcttatgtaaaaaaactttcagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 2190 - DNA, 3234 bp, Homo sapiens
gcagagttctgaagcagtttatattcttcttacattttgccttctcctagctggaaagcagagggactggaatttttgaaacgggcttttcccataatggcattcttgatttgtgtggccagagcttgcacaggaggaaagcaggctgctgaatttagtcactgatctctattagcggtagcctaaggctatgctgaggtttatatcccatttgtattgttgcagctcaaaagaagattgttcagaggatgacaagtgtattctgagtagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 2191 - DNA, 3256 bp, Homo sapiens
ggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtca

SEQ ID NO: 2192 - DNA, 3972 bp, Homo sapiens; identical to SEQ ID NO: 2188

SEQ ID NO: 2193 - DNA, 306 bp, Homo sapiens
cattatccaacttttagaggtgatggatcatctgcatagaggggaattggttgctgcaatacttcgtaaccggagacggaggcaattgtcattaaaacaagccgatttcaaggatatattcaaaaaatcaacttcaggatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaagg

SEQ ID NO: 2194 - DNA, 2353 bp, Homo sapiens
agagaatttgatgagagagggatccacaagaacatgacaaatgatgagagttcaaaccttaagagaaaaatgggcttattggagacggaggcaattgtcattaaaacaagccgatttcaaggatatattcaaaaaatcaacttcaggatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataag

SEQ ID NO: 2195 - DNA, 3071 bp, Homo sapiens
atgatgagagttcaaaccttaagagaaaaatgggcttattggagacggaggcaattgtcattaaaacaagccgatttcaaggatatattcaaaaaatcaacttcaggatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 2196 - DNA, 3396 bp, Homo sapiens
actgccccctccctccccaactgggttcccgcccccctccctcagcagcccccccacaccctggtgaggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaaggtcattatccaacttttagaggtgatggatcatctgcatagaggggaattggttgctgcaatacttcgtaaccgatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 2197 - DNA, 3102 bp, Homo sapiens
tagaagagtgatatttgtgtgagagcctgggtcaggcttattttgagacgtgggccccactgaggtcattatccaacttttagaggtgatggatcatctgcatagaggggaattggttgctgcaatacttcgtaaccgatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 2198 - DNA, 3322 bp, Homo sapiens
actgccccctccctccccaactgggttcccgcccccctccctcagcagcccccccacaccctggtgaggtcaggcggaggctctgccgctgcggccgcagtagctcagctcctattcctgggaagcctggaacggggacttttgaaaataactgcagcggcattcgggttagggtccgtgctctccgcctgcgccaggacagggtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 2199 - DNA, 1662 bp, Homo sapiens
aaagcactcgcatccctttccaatttacccgagcaccttctcttcactcagccaactgctcgctcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctgcgggctggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 2200 - DNA, 1562 bp, Homo sapiens
cggagggcgcgggggtggggcccggggcggagcggcccggggcggagggcgcgggctccgagccgtccacctgtggctccggcttccgaagcggctccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 2201 - DNA, 1420 bp, Homo sapiens
gcagcctcgagggccaacaacacctgctgtccgtgtccatgcccggttggccaccccgtttctgggggcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttc

SEQ ID NO: 2202 - DNA, 1390 bp, Homo sapiens
gctcctcccgcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcctttcgcgcgcccagcattcacgggggctccggcggccgcggcgtatccgtgtcctccgcccgctttgtgtcctcgtcctcctcgggggcctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaaggga

SEQ ID NO: 2203 - DNA, 641 bp, Homo sapiens
gcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcctttcgcgcgcccagcattcacgggggctccggcggccgcggcgtatccgtgtcctccgcccgctttgtgtcctcgtcctcctcgggggcctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggcc

SEQ ID NO: 2204 - DNA, 2531 bp, Homo sapiens
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatataa

SEQ ID NO: 2205 - DNA, 2131 bp, Homo sapiens
aacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatat

SEQ ID NO: 2206 - DNA, 542 bp, Homo sapiens
actgtgcaggtgtgaccggtgagctcacagctgccccccaggcatgcccagcccacttaatcattcacagctcgacagctctctcgcccagcccagttctggaagggataaaaagggggcatcaccgttcctgggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggcttt

SEQ ID NO: 2207 - DNA, 1754 bp, Homo sapiens
agagggcggagggcggccccaggaggggcctggcagcagagaaaggtggcccgcggcagccccgcccctacctgtggaagcccagccgcccgctcccgcggataaaaggcgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcacggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccaccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcgcagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcggggcaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatcca

SEQ ID NO: 2208 - DNA, 1550 bp, Homo sapiens
agcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcacggccgcgcgtggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataggtacgaagatgaaattaaccaccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcgcagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcggggcaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgat

SEQ ID NO: 2209 - DNA, 1336 bp, Homo sapiens
cagccccgcccctacctgtggaagcccagccgcccgctcccgcggataaaaggcgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcacggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccaccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagatccatgttctccaatcccacatctcagacacctctgtggttgtcaagctggacaacagccaggacctgaacatggactgcatcattgccgagatcaaggcacagtatgacgacattgtcacctgcagctgggccaaggctgagtcttggtaccatggctgcctggagatgaaggccacggtgatctggcacggggagactgtgggctgcaccaaggaggagatcaaggagctgacccacatgatccagaggctgatggccaaggtggagaatgccaagtgccagaactccaagctggaggtggaggtgacccagtctgagcagcagggtgaggtggcccttagcgataaccgctgcaagctggttgagctggagggcaccatgcagaaggccaggcagtaccaggaggtgatgaactccaagctgggcctcaatgtgaaggctgcctcttcttgccaccttctagatggtgaggagcagaggctgtgtgatggcatcagtgctgtgaatatc

SEQ ID NO: 2210 - DNA, 1777 bp, Homo sapiens
ctgagagctctcctcaccaagaagcagcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgc

SEQ ID NO: 2211 - DNA, 1165 bp, Homo sapiens
gtgtctcctcctctttacaggcctttccttacctccctccatgctgtccacttcctctgtaaagctctcaaccctgtccccttccccctctctcctgggaaagagccctcccatgcctagctgctgctcttagggaccctgtggctaggtgcgcggatggaaatccagccctcaggtcctcgatgatcttgaagtaatggctccagtctctgacctggggtcccttcttctccaagtgctcccggattttgctctccagcctccggttctcggtctccaggctcctcactctgtccaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcag

SEQ ID NO: 2212 - DNA, 1755 bp, Homo sapiens
gtaaagctctcaaccctgtccccttccccctctctcctgggaaagagccctcccatgcctagctgctgctcttagggaccctgtggctaggtgcgcggatggaaatccaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctg

SEQ ID NO: 2213 - DNA, 729 bp, Homo sapiens
gacctaaacctcctgccttccacccacagcatgccctgcctggccccacccaggcctggggtgccttgctcagctccccaatctccaacctcccacaggccattcctgagagctctcctcaccaagaagcagcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaa

SEQ ID NO: 2214 - DNA, 1687 bp, Homo sapiens
attcagcaaatgtttgcggaatgaatggggtgagctggagccaggacctgcaggaagggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctg

SEQ ID NO: 2215 - DNA, 2120 bp, Homo sapiens
atgctgtccacttcctctgtaaagctctcaaccctgtccccttccccctctctcctgggaaagagccctcccatgcctagctgctgctcttagggaccctgtggctaggtgcgcggatggaaatccaggtatgcccaaccccctcccggtggagtaggggttgggtggttatggaatgacggaaagaggcaaaggagtgtataattggagggtcagacaaggctgggagttgaggtccctcctaccccttacctgagccctcaggtcctcgatgatcttgaagtaatggctccagtctctgacctggggtcccttcttctccaagtgctcccggattttgctctccagcctccggttctcggtctccaggctcctcactctgtccaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgcc

SEQ ID NO: 2216 - DNA, 5831 bp, Homo sapiens
tcccgggaccccgggagagcggtcaatgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcctggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaa

SEQ ID NO: 2217 - DNA, 6957 bp, Homo sapiens
caatttaagcctgtggcatggaacctaaagactagaggcggttgtgtgagtcaggaagaggggccagatatctgagtgttcctctttagtttcttcaattgcagataatatggtgtctaattttatgttgttcaggaaagacagtggttcctgactcaggaagacagtctcagaaacatgtggaatgatattgagctgctaacaaatgatgataccggaagtgggtacctgagtgtcggttcaagaaaagaacatggaactgctttatatcaagtagatttgctagtgaagatctcttctgaaaaggcctcattaaatccaaagatacaggcatgcagcttaagtgatgggtttattattgtagccgaccaatcagtgatattgcttgacagtatttgtagatcacttcaattgcatcttgtctttgatactgaagtggatgtagttggcctttgtcaagaaggaaagtttcttttggttggcgagagaagtggcaacctacatcttattcatgtaacatcaaaacaaacactactcactaatgcatttgttcagaaagctaacgatgaaaatcggcggacttaccagaatcttgtcattgagaaggatggttcaaatgaaggtacctattatatgctacttcttacatacagtggatttttttgtattacaaaccttcagcttttaaaaattcaacaagcaattgagaatgtagacttcagtacagcaaaaaagttacaaggacaaatcaagtccagttttatttctactgaaaattatcatactcttggttgtctcagtcttgtggctggagatttagcaagtgaagttcctgtgataattgggggaaccggtaattgtgcattctcaaaatgggaaccagattcttccaagaaaggaatgacagttaagaaccttattgatgcagagattattaaaggtgcaaagaagttccagctgatagacaatctactttttgttcttgatactgataacgtgctgagtttatgggatatttacactctaactcctgtatggaactggccctctcttcacgtagaagagtttcttcttactacagaagcagactctccttcatcagtcacgtggcaaggaattacaaatctcaaattaatagctctgacagcttcagctaataagaagatgaaaaacctcatggtttattcattacctacaatggaaatactatattctttggaagtatctagtgtttcttctctggtccaaacaggaattagcacagataccatataccttttagaaggagtttgcaaaaatgatccaaaattgtctgaagactcagtctctgtgttagtactcagatgtcttacggaagctttaccagaaaacagattgagtcggttacttcacaaacacagatttgctgaagctgagagttttgccattcagtttggactagatgttgagcttgtttacaaggtcaagtcaaatcatatattggagaaactggcattgagttctgtggatgccagtgaacagaccgaatggcaacaacttgtagacgacgctaaggaaaatctacataagatccaggatgatgaatttgtggtgaattactgcctgaaagctcagtggataacctatgaaaccactcaagagatgctgaattatgccaaaaccaggcttttgaagaaagaagataaaactgctctcatttattctgatggcttgaaagaggtgctaagagctcatgcaaaattgactactttttatggagcatttggaccagaaaaattcagtggcagttcttggattgaatttctaaataatgaagatgatcttaaagatatttttttacagctaaaagaaggaaaccttgtttgtgcacagtatctttggcttcgacatcgggcaaactttgaaagcagatttgatgtgaaaatgctggagagcttgctcaactcaatgtctgcatcagtctctttgcaaaagctgtgtccatggtttaaaaatgatgtgattccatttgtaagaaggactgtgcctgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataagttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagca

SEQ ID NO: 2218 - DNA, 2395 bp, Homo sapiens
tatagtttagatgaataatgttaaagagaatactagaaaaggttttgatcctctttctgaaaacaagatggtctcaggaatggaaacttttgatggtatactattagatgattttatgacagtttaggattgggttactcttactggacaaaagttttttattttaatataggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcagagatggaggtcttgctatgttgcctaggctggtcttagaactcctgagctgaaacaatcctcctgccttggcctcccaaagtactgggattacaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcat

SEQ ID NO: 2219 - DNA, 709 bp, Homo sapiens
ctcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgcggggcgggggcggggggcggggacgtagggctaagggagggggcgctggagcttccaacccgaggcaataaaagaaatgttgcgtaactca

SEQ ID NO: 2220 - DNA, 1624 bp, Homo sapiens
gccgagcccagcacagctgccctctggaccctgcggaccccagccgagccccttcctgagttccacaggcgcagcccccgggcggtcgggcggaggggtccccggggcggtgccagggcgcaatcctggagggcggccgggaggaggaggtgcgcgcggccatgcacaccgtggctacgtccggacccaacgcgtcctggggggcaccggccaacgcctccggctgcccgggctgtggcgccaacgcctcggacggcccagtcccttcgccgcgggccgtggacgcctggctcgtgccgctcttcttcgcggcgctgatgctgctgggcctggtggggaactcgctggtcatctacgtcatctgccgccacaagccgatgcggaccgtgaccaacttctacatcgccaacctggcggccacggacgtgaccttcctcctgtgctgcgtccccttcacggccctgctgtacccgctgcccggctgggtgctgggcgacttcatgtgcaagttcgtcaactacatccagcaggtctcggtgcaggccacgtgtgccactctgaccgccatgagtgtggaccgctggtacgtgacggtgttcccgttgcgcgccctgcaccgccgcacgccccgcctggcgctggctgtcagcctcagcatctgggtaggctctgcggcggtgtctgcgccggtgctcgccctgcaccgcctgtcacccgggccgcgcgcctactgcagtgaggccttccccagccgcgccctggagcgcgccttcgcactgtacaacctgctggcgctgtacctgctgccgctgctcgccacctgcgcctgctatgcggccatgctgcgccacctgggccgggtcgccgtgcgccccgcgcccgccgatagcgccctgcaggggcaggtgctggcagagcgcgcaggcgccgtgcgggccaaggtctcgcggctggtggcggccgtggtcctgctcttcgccgcctgctggggccccatccagctgttcctggtgctgcaggcgctgggccccgcgggctcctggcacccacgcagctacgccgcctacgcgcttaagacctgggctcactgcatgtcctacagcaactccgcgctgaacccgctgctctacgccttcctgggctcgcacttccgacaggccttccgccgcgtctgcccctgcgcgccgcgccgcccccgccgcccccgccggcccggaccctcggaccccgcagccccacacgcggagctgctccgcctggggtcccacccggcccccgccagggcgcagaagccagggagcagtgggctggccgcgcgcgggctgtgcgtcctgggggaggacaacgcccctctctgagcggacccggtgggaatccgagcggctccctcgggagcggggactgctggaacagcggctattcttctgttattagtatttttcttactgtccaagatcaactgtggaaatattttggtctcttgtgacgttcggtgcagtttcgttgtgaagtttgctattgatattgaaattatgacttctgtgtttcctgaaattaaacatgtgtcaacacaggactttctggatcattccagaaagtgtcagacgttttctcattgtcttgt

SEQ ID NO: 2221 - DNA, 6912 bp, Homo sapiens
ggtccgcggcggagcgagcgagcggccggcaggttgggaggagcggccgaaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatggtaacttttctcactcacagtcattggcatcaggattctagggccagcattgccagcattccaatttaatgtcaatgtaccttttaaattgacctggaagaaagttaatatcgttatttggaaggtaggcccagaatatctttaaataaggttaccaaagaggccgggcatggtggctcacacctgtgatcccagcactttgggaggccaaggcaggcagatcatttgaggccaggagttcgagaccagcctggccaacatggtgaaaccccatctctactaaaaaatacaaaaattagccaggcatggtggtgcacacctgtagtcccagctactccggcggctgaggtgggagaatcacttgaacctgggaggtggaggttgcagtgagctgagatcacgccactgcactccagcctgggtgacagaaagaggccctgtctcaaaattacgaaagaaagctgtacaagaaagcttacctgatattacaaattatgaaatattttaaatagcattttattcacgttctggcaggcataagttttttcaggttatctcagctgaagaagaataataatccctgtttagtacgtaaatggtccttgaggctcgtgagacacgacatcactttataagcagtaaagccggatacaaatgtcagttttcactggctttgttatgtctggaaggactaattgatttttttcccatgtgaagaatgttattaatggaactttgaattattttctttgcatgcacacactttcccattgaattttgtggaaacttctcacatatatatgccaagatctacatttacatgcatgagaaaagaactgtacaggaaaaaagatcatttaacatgtatgggtgtgagttttcatttttattgccttgactttttcacagcatgtacaaacaatgaaagtacactgaagtccatcatgaagaagaaagatggtaacaaagattcaaatggcgcaaaaaagaatcttcagtttgttggcattaatggagggtaaggaaagatggtggttctagaggctaatgctgtcagtctcctttacctcctgcctaagtcacatttcaaggcgcctagtcggggaagcggccacagcgcagtgatgaaagattccctcctcagaaaggcagaaaggtgcatttgggctttgctttcctcctctggtgctgtctttaaggatttgtcactctcttaaggatacctgatgaagctgagcggtttacatctcctcacctctgatctgaaagaaatagtcttcagcgaacgcagcagggttcctgcactgtgttggacaacttgtacttacctatacgagaactcacaattgagcagaaaaagactgagagcatcactctctgggccaacgatcgtcatcttttccttcaaaatgggtccttttgcttagctctccatgtttacgacccaaattgtagggcctttcacaattgataaccacatcaccagtttgctttctaaatagaatggttattgtttgttccttctctttgcattggcccacgtacatagttaagcccctttgttgtcctacaattgaatcaaatcaatgaattgatacatggcccccacaagaaagaaataatacaaagtgtaccattagggtttaaccttatggtgcctgttttccaaatctagaagttttattcagtgataatggccaggagattttggagggcatacaccagaaaaactatcgattgcctatgtaatctattccccttgatactgggagaattaataggatgaaataggaagacatggggtgggggggggacaaaaagcacctaccgatctgttttccataaagtatgttttctcatgatttatgctaagccggagatgccattattttctttaacaagtgttacatgataccaattggttatatgataccgataaccagtttaagttagagtccattcaaaaccaccaggcatttaaatagaccttactttgaacttctaagtgcaggatctaaaaccactagtgaaatttctggagtcaattagcaaatcccttcatagaaatttctatcactgggtcttcgtgagcacaccttgcatctcctgaaatcccaattgccacctaggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtgtggtacattccccttccctcccttgcccctcccacatttaatgtactttggcaatagagttggccagttcagagcttttgtaattaaatgtttgcttttatctgttcctcagaggtatacacatcttgagatactaatatatacaagtgcagagtattacaactcttagatctcttatggtagaatggcctggtacctaatcacccttgttttctgaaaccttaactctgctatataatttaacatatggaaccacaatccactaaaacttgcattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcacatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagaccattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaaaacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatggatatatggtaatttgtggaaagtcaaggcaagaggatcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcgagaccagcctgggcaacatggtgaaaccctgtctctacaaatacaaagccgggtgtggtggcacacacgtgtaatcccagttacttgggaagctgaggtaggaagattgcttgagcctgggacagcaaaactacagtgagccgtgattgcaccactgcactccagcctgggcaacagagtgagaccttgtctcaaaaaaaaaaaaaaaaaaaaa

SEQ ID NO: 2222 - DNA, 2268 bp, Homo sapiens
aggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccggtcagtgttgtgcatttggcatttgtaaataggctgaaatccaccagactggtggacccccttcctccaggaattgacgggagacagattttatgttgattcagaaaatggaagttttagtctggagcttaagagttcatcctttccgcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgttctcagccagagctctcctggctcgggctcacagctgcttgttgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctt

SEQ ID NO: 2223 - DNA, 1948 bp, Homo sapiens
ctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgggccaggtgcagtggctgacacctatgatcccaacacttcgggaggccgatgcaggtggatcacatgagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctc

SEQ ID NO: 2224 - DNA, 5249 bp, Homo sapiens
gaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctct

SEQ ID NO: 2225 - DNA, 5051 bp, Homo sapiens
gcgagcgagcggccggcaggttgggaggagcggccgaaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctcttt

SEQ ID NO: 2226 - DNA, 5581 bp, Homo sapiens
gcccgagggtgtttcggggcgtccgaagcgggcgtgctccagcctgctcagcagcgagtggttggaaattagcaaagtgagagggtgaaaggaagcaggaggaggagggagttctagcgaagacttcggagggaagcaacccatcccctgccacaagaaagcaccgccactccagtgggaacggacacgcgtgcacacagccacgagtgaggagagaatacagcagttccaaggacaagggattcgtaccactgctcctcactcagtaaatagcagagacagaatttgaacggtctcactctgtcacctgagctagagtgcagtggtgcgatcacagcttactgcagcattgaactcctgggctcaagtgatcctcttgcctcagcctcccaagtaactgtgactgcagtgtccttgctggccttgcaaaatgagtttggaagggttgattccatcctcttcagttgttggaaagagtttaagaagggttggtgttaattcttctctttaaatatttgatgaaattcaccagtgaagccgtgacatcctgggatattctttgttgagaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctcttt

SEQ ID NO: 2227 - DNA, 5131 bp, Homo sapiens
ggtccgcggcggagcgagcgagcggccggcaggttgggaggagcggccgaaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgggccaggtgcagtggctgacacctatgatcccaacacttcgggaggccgatgcaggtggatcacatgagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctct

SEQ ID NO: 2228 - DNA, 4553 bp, Homo sapiens
gctccggctcagccgctggcacccccaccgccaccaccctagtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtaacggcggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccacataacactgttatttaaaacagttttctgcagtctataaacatttctcaacatttttttaaaagtcttagttaaaatgtaaatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataa

SEQ ID NO: 2229 - DNA, 2827 bp, Homo sapiens
atagccacggtaacggcggggtggaaagctaaggcctttgaagacctgggaccccgtagtttcgggagagggtgaggggtgaatggtgctgaggtgcgaggagagggaaggacagtaaagagcaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaagtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctc

SEQ ID NO: 2230 - DNA, 3143 bp, Homo sapiens
agcgatttcatagccacggtaacggcggggtggaaagctaaggcctttgaagacctgggaccccgtagtttcgggagagggtgaggggtgaatggtgctgaggtgcgaggagagggaaggacagtaaagagcaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaa

SEQ ID NO: 2231 - DNA, 4762 bp, Homo sapiens
gctccggctcagccgctggcacccccaccgccaccaccctagtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccacataacactgttatttaaaacagttttctgcagtctataaacatttctcaacatttttttaaaagtcttagttaaaatgtaaatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataagttcagagatatagtcatatttaaagttgtcctacagtttgcagataatttttatattactattcttcacattaacttctgcttatttttaatggtactatatgtaggccttattaaaattaagattgtatggttaagtaaagttaacaagaaagcctgatttatctttaattctgtgctaggtacttttgattctacatgaacaatacccttttcagttcccttcattctaatgtcctcaactgttaccaaataccctgttgactcccaaacctaagattttagcctcaacttcttttctgaacttcaaatcttaatttccaagttatacttgttctaggtccatctaaatggtctacagagaacttcagttgaatcatagctggaaacagaatttatttcctctatttgcttcattctgtccttccactatattccctattt

SEQ ID NO: 2232 - DNA, 3378 bp, Homo sapiens
gagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaa

SEQ ID NO: 2233 - DNA, 551 bp, Homo sapiens
atagccacggtaacggcggggtggaaagctaaggcctttgaagacctgggaccccgtagtttcgggagagggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattgg

SEQ ID NO: 2234 - DNA, 3056 bp, Homo sapiens
tcgggagagggtgaggggtgaatggtgctgaggtgcgaggagagggaaggacagtaaagagcaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctc

SEQ ID NO: 2235 - DNA, 483 bp, Homo sapiens
acccggaagcgatttcatagccacgcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattct

SEQ ID NO: 2236 - DNA, 546 bp, Homo sapiens
agccacggtaacggcggggtggaaagctaaggcctttgaagacctgggaccccgtagtttcgggagagggtgaggggtgaatggtgctgaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgt

SEQ ID NO: 2237 - DNA, 572 bp, Homo sapiens
gcaaagggtgtgaacccggaagcgatttcatagccacggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcat

SEQ ID NO: 2238 - DNA, 702 bp, Homo sapiens
acctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcc

SEQ ID NO: 2239 - DNA, 855 bp, Homo sapiens
gatttcatagccacggtaacggcggggtggaaagctaaggcctttgaagacctgggaccccgtagtttcgggagagggtgaggggtgaatggtgctgaggtgcgaggagagggaaggacagtaaagagcaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagc

SEQ ID NO: 2240 - DNA, 557 bp, Homo sapiens
atagccacggtaacggcggggtggaaagctaaggcctttgaagacctgggaccccgtagtttcgggagaggttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttatt

SEQ ID NO: 2241 - DNA, 783 bp, Homo sapiens
tcatgttccagccttgcgcgctcgcagccccggccgccctcttcccctcccccgcctccggctccggctccggctcagccgctggcacccccaccgccaccaccctagtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaa

SEQ ID NO: 2242 - DNA, 665 bp, Homo sapiens
catagccacggtaacggcggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaactt

SEQ ID NO: 2243 - DNA, 978 bp, Homo sapiens
atagccacggtaacggcggggtggaaagctaaggcctttgaagacctgggaccccgtagtttcgggagagggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagt

SEQ ID NO: 2244 - DNA, 1472 bp, Homo sapiens
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgg

SEQ ID NO: 2245 - DNA, 507 bp, Homo sapiens
gcaaagggtgtgaacccggaagcgatttcatagccacggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacaca

SEQ ID NO: 2246 - DNA, 1615 bp, Homo sapiens
tcagagttcacgaggcagccgaggaagaggaggcttgaggcccagggtgggcaccagccagccatggccacagccgagaccgccttgccctccatcagcacactgaccgccctgggccccttcccggacacacaggatgacttcctcaagtggtggcgctccgaagaggcgcaggacatgggcccgggtcctcctgaccccacggagccgcccctccacgtgaagtctgaggaccagcccggggaggaagaggacgatgagaggggcgcggacgccacctgggacctggatctcctcctcaccaacttctcgggcccggagcccggtggcgcgccccagacctgcgctctggcgcccagcgaggcctccggggcgcaatatccgccgccgcccgagactctgggcgcatatgctggcggcccggggctggtggctgggcttttgggttcggaggatcactcgggttgggtgcgccctgccctgcgagcccgggctcccgacgccttcgtgggcccagccctggctccagccccggcccccgagcccaaggcgctggcgctgcaaccggtgtacccggggcccggcgccggctcctcgggtggctacttcccgcggaccgggctttcagtgcctgcggcgtcgggcgccccctacgggctactgtccgggtaccccgcgatgtacccggcgcctcagtaccaagggcacttccagctcttccgcgggctccagggacccgcgcccggtcccgccacgtccccctccttcctgagttgtttgggacccgggacggtgggcactggactcggggggactgcagaggatccaggtgtgatagccgagaccgcgccatccaagcgaggccgacgttcgtgggcgcgcaagaggcaggcagcgcacacgtgcgcgcacccgggttgcggcaagagctacaccaagagctcccacctgaaggcgcatctgcgcacgcacacaggggagaagccatacgcctgcacgtgggaaggctgcggctggagattcgcgcgctcggacgagctgacccgccactaccggaaacacacggggcagcgccccttccgctgccagctctgcccacgtgctttttcgcgctctgaccacctggccttgcacatgaagcgccacctttgagccctgccctggcacttggactctcctagtgactggggatgggacaagaagcctgtttggtggtctcttcacacggacgcgcgtgacacaatgctgggtggttttcccacgaatggaccctctcctggactcgcgttcccaaagatccacccaaatatcaaacacggacccatagacagccctgggggagcctcttacggaaaatccgacaagccttcagccacagggagccacacagagatgtccaaactgtcgtgcaaacccagtgagacagaccgccaaataaacggactcagtggacactcagaccagctcccagatggccctggacagcaggagagggtgtgggatgaggcttcccagagaccctgggtctagaaagcggctcctgaaggtcccttattgtggctgatattaactgtcaatggttatgggtcctataaaaatgcccctcccagataaa

SEQ ID NO: 2247 - DNA, 1922 bp, Homo sapiens
taaaagccgggcgttcggaggacccagcaattagtctgatttccgcccacctttccgagcgggaaggagagccacaaagcgcgcatgcgcgcggatcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 2248 - DNA, 1766 bp, Homo sapiens
agtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcaggg

SEQ ID NO: 2249 - DNA, 2416 bp, Homo sapiens
agtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggtgcagtggctcatgcctataatcccagcactttgggaagcccaggtgggctgatcactggaggccaggaattggggaccagcctggccaacacaacaaaaccccatctgttaaaaaaacaaaacaaaaccaaaaaaaacaagtaaccttggtggatgtctactcaagttttctgcacatttttctgaaaatacaactgtgaccctta

SEQ ID NO: 2250 - DNA, 1310 bp, Homo sapiens
agtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctg

SEQ ID NO: 2251 - DNA, 1310 bp, Homo sapiens
gtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgag

SEQ ID NO: 2252 - DNA, 732 bp, Homo sapiens
gacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccaggtgaggcttttgact

SEQ ID NO: 2253 - DNA, 682 bp, Homo sapiens
gctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggaggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaa

SEQ ID NO: 2254 - DNA, 465 bp, Homo sapiens
gtgctgcagccgctgccgccgattccggatctcattgccacgcgcccccgacgaccgcccgacgtgcattcccggtgggctccgtgagggcagctgctgcctgcagattatagggagccctttgcgcatttattaagaagctactggtgtatctcgggctgcgctaggcacggcgcatgcaaagatgaagcaggcagcatcccagcccttccgcacctcagacgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttcctta

SEQ ID NO: 2255 - DNA, 2305 bp, Homo sapiens
ttgggcggggcgtaaaagccgggcgttcggaggacccagcaattagtctgatttccgcccacctttccgagcgggaaggagagccacaaagcgcgcatgcgcgcggatcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcaggg

SEQ ID NO: 2256 - DNA, 1288 bp, Homo sapiens
gaaccctcaggaggctatacttacacccaaacgtcgatattccttttccacgctaaggtatgggccttcactcttcacagaccctgtcattaggcctttcaactctcttttggcaaccattaggttttttcccctccctttttagtcatctctagtgatttatagtggcaaatacccccaaaggaagtaaaatagcttaaaaaaatctcttggttaataaacattaaagaagctgtagtgacactaaatgtttttcctcctatagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaa

SEQ ID NO: 2257 - DNA, 576 bp, Homo sapiens
agagtgctgcagccgctgccgccgattccggatctcattgccacgcgcccccgacgaccgcccgacgtgcattcccggtacgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccg

SEQ ID NO: 2258 - DNA, 1887 bp, Homo sapiens
tccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcaggg

SEQ ID NO: 2259 - DNA, 4256 bp, Homo sapiens
aacccctatatcaatggacttttcctctaatacatggtactgctgtattaaccactttatagctttcctttctttctttcttttacagagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaatttaactttccatcagggagacctggaatgcagaatggtactggacaaactgatttcatgatacaccaaaatgttgtccctgctggcactgtgaatcggcagccaccacctccatatcctctgacagcagctaatggacaaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggttggattatctcaagatgcccaggatcaaatgagaaagatgctttgccaaaaagaatctaattacatccgtcttaaaagggctaaaatggacaagtctatgtttgtgaagataaagacactaggaataggagcatttggtgaagtctgtctagcaagaaaagtagatactaaggctttgtatgcaacaaaaactcttcgaaagaaagatgttcttcttcgaaatcaagtcgctcatgttaaggctgagagagatatcctggctgaagctgacaatgaatgggtagttcgtctatattattcattccaagataaggacaatttatactttgtaatggactacattcctgggggtgatatgatgagcctattaattagaatgggcatctttccagaaagtctggcacgattctacatagcagaacttacctgtgcagttgaaagtgttcataaaatgggttttattcatagagatattaaacctgataatattttgattgatcgtgatggtcatattaaattgactgactttggcctctgcactggcttcagatggacacacgattctaagtactatcagagtggtgaccatccacggcaagatagcatggatttcagtaatgaatggggggatccctcaagctgtcgatgtggagacagactgaagccattagagcggagagctgcacgccagcaccagcgatgtctagcacattctttggttgggactcccaattatattgcacctgaagtgttgctacgaacaggatacacacagttgtgtgattggtggagtgttggtgttattctttttgaaatgttggtgggacaacctcctttcttggcacaaacaccattagaaacacaaatgaaggttatcaactggcaaacatctcttcacattccaccacaagctaaactcagtcctgaagcttctgatcttattattaaactttgccgaggacccgaagatcgcttaggcaagaatggtgctgatgaaataaaagctcatccattttttaaaacaattgacttctccagtgacctgagacagcagtctgcttcatacattcctaaaatcacacacccaacagatacatcaaattttgatcctgttgatcctgataaattatggagtgatgataacgaggaagaaaatgtaaatgacactctcaatggatggtataaaaatggaaagcatcctgaacatgcattctatgaatttaccttccgaaggttttttgatgacaatggctacccatataattatccgaagcctattgaatatgaatacattaattcacaaggctcagagcagcagtcggatgaagatgatcaaaacacaggctcagagattaaaaatcgcgatctagtatatgtttaacacactagtaaataaatgtaatgaggatttgtaaaagggcctgaaatgcgaggtgttttgaggttctgagagtaaaattatgcaaatatgacagagctatatatgtgtgctctgtgtacaatattttattttcctaaattatgggaaatccttttaaaatgttaatttattccagccgtttaaatcagtatttagaaaaaaattgttataaggaaagtaaattatgaactgaatattatagtcagttcttggtacttaaagtacttaaaataagtagtgctttgtttaaaaggagaaacctggtatctatttgtatatatgctaaataattttaaaatacaagagtttttgaaatttttttgaaagacagttttagttttatcttgctttaaccaaatatgaaacataccccctattttacagagctcttttttcccctcataaccttgtttttggtagaaaataagctagagaaattaagccatcgtgttggtgagtgttcctaggctaatgataatctgtataattcacatcctgaaactaaggaatacagggttgaaaaaatattaatatgtttgtcagaaggaaaaataatgcatttatcttcccccccaccccccgccccatggaatatt

SEQ ID NO: 2260 - DNA, 2567 bp, Homo sapiens
ctgcagcggagtgcggcggcggcgacactgagtggaaggcaaaatggcggcggcggcggcggtggcctggtgttaaggggagagccaggtcctcacgacccctgggacgggccgcgctggcccgcggcagcccccccgttcgtctccccgctctgccccaccagggatacttggggttgctgggacggactctggccgcctcagcgtccgccctcaggcccgtggccgctgtccaggagctctgctctcccctccagagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaatttaactttccatcagggagacctggaatgcagaatggtactggacaaactgatttcatgatacaccaaaatgttgtccctgctggcactgtgaatcggcagccaccacctccatatcctctgacagcagctaatggacaaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggtaaaaccttttaaaatgtccatttttatacttaatcatctgtttgcttggtgtttattttaaaatattgtgtccagtatttttctttctttttatagctaaataaaatatattatcagttatggaatttaaaagtgaataaatattaaagtacttttga

SEQ ID NO: 2261 - DNA, 7517 bp, Homo sapiens
gcgacgctcacgaacgatcagagctgcgggcgacgcaacgaagcccggaggccgcaggctgcgcgctccctcgcagcagccgggcgggcaaaagcccccagtcctcggcccccgcgcaagcgacgccgggaaatgcccacatccgggaaacctgcagcggagtgcggcggcggcgacactgagtggaaggcaaaatggcggcggcggcggcggtggcctggtgttaaggggagagccaggtcctcacgacccctgggacgggccgcgctggcccgcggcagcccccccgttcgtctccccgctctgccccaccagggatacttggggttgctgggacggactctggccgcctcagcgtccgccctcaggcccgtggccgctgtccaggagctctgctctcccctccagagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaatttaactttccatcagggagacctggaatgcagaatggtactggacaaactgatttcatgatacaccaaaatgttgtccctgctggcactgtgaatcggcagccaccacctccatatcctctgacagcagctaatggacaaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggttggattatctcaagatgcccaggatcaaatgagaaagatgctttgccaaaaagaatctaattacatccgtcttaaaagggctaaaatggacaagtctatgtttgtgaagataaagacactaggaataggagcatttggtgaagtctgtctagcaagaaaagtagatactaaggctttgtatgcaacaaaaactcttcgaaagaaagatgttcttcttcgaaatcaagtcgctcatgttaaggctgagagagatatcctggctgaagctgacaatgaatgggtagttcgtctatattattcattccaagataaggacaatttatactttgtaatggactacattcctgggggtgatatgatgagcctattaattagaatgggcatctttccagaaagtctggcacgattctacatagcagaacttacctgtgcagttgaaagtgttcataaaatgggttttattcatagagatattaaacctgataatattttgattgatcgtgatggtcatattaaattgactgactttggcctctgcactggcttcagatggacacacgattctaagtactatcagagtggtgaccatccacggcaagatagcatggatttcagtaatgaatggggggatccctcaagctgtcgatgtggagacagactgaagccattagagcggagagctgcacgccagcaccagcgatgtctagcacattctttggttgggactcccaattatattgcacctgaagtgttgctacgaacaggatacacacagttgtgtgattggtggagtgttggtgttattctttttgaaatgttggtgggacaacctcctttcttggcacaaacaccattagaaacacaaatgaaggttatcaactggcaaacatctcttcacattccaccacaagctaaactcagtcctgaagcttctgatcttattattaaactttgccgaggacccgaagatcgcttaggcaagaatggtgctgatgaaataaaagctcatccattttttaaaacaattgacttctccagtgacctgagacagcagtctgcttcatacattcctaaaatcacacacccaacagatacatcaaattttgatcctgttgatcctgataaattatggagtgatgataacgaggaagaaaatgtaaatgacactctcaatggatggtataaaaatggaaagcatcctgaacatgcattctatgaatttaccttccgaaggttttttgatgacaatggctacccatataattatccgaagcctattgaatatgaatacattaattcacaaggctcagagcagcagtcggatgaagatgatcaaaacacaggctcagagattaaaaatcgcgatctagtatatgtttaacacactagtaaataaatgtaatgaggatttgtaaaagggcctgaaatgcgaggtgttttgaggttctgagagtaaaattatgcaaatatgacagagctatatatgtgtgctctgtgtacaatattttattttcctaaattatgggaaatccttttaaaatgttaatttattccagccgtttaaatcagtatttagaaaaaaattgttataaggaaagtaaattatgaactgaatattatagtcagttcttggtacttaaagtacttaaaataagtagtgctttgtttaaaaggagaaacctggtatctatttgtatatatgctaaataattttaaaatacaagagtttttgaaatttttttgaaagacagttttagttttatcttgctttaaccaaatatgaaacataccccctattttacagagctcttttttcccctcataaccttgtttttggtagaaaataagctagagaaattaagccatcgtgttggtgagtgttcctaggctaatgataatctgtataattcacatcctgaaactaaggaatacagggttgaaaaaatattaatatgtttgtcagaaggaaaaataatgcatttatcttcccccccaccccccgccccatggaatatttaatctatttaatcttcttgcatttatttctcaagaattactggctttaaaagaagccaaagcactactagctttttttccatattggtatttttgatgctgcttccaattttaaaagggaacaaagctgccataaatcgaaatgttcaatactaaaagctaaaatatttctcaccatcctaagcagataattattttaattttcatatacttttcctgtatagtaactattttgattatatcatcaatgttacctgtttcctctttcagaacagtgctgcatatacagattgttattggcaaaggaaaatctggctatctggcaatattttacctaagcgcagattaattggtgaaaaaattaactcttaagatggccattaataattaggaaagtttacagagtggtcttagtagaaaattcaagtcctcctaatttatttaaggttcaataatgcgttcaacatgcctgttatgtataacgcttaggttctaaggaagattaaggtttcataccaaaatacatgtagcttatcttttaggaaggggaaaaaggctccattttgaccatagtaaaatttgtgttgtgttttatttccttttcttaagctccactgataagggattgtttttatcaaaagttactatttgtagattggaggcataattttagtgattttcatacttttagctttcttcgcataaaagctaattgaaaccgtatatgtagtaaaattaaaggcagagctgttgcagttgaattggagagttagggcaaagaacacttattagcccacacttcccacctttctacaggtggtcctttcagagctcagcctgaaaacccactactgtgttatcgtgcgtcttttggggttagtggttcttttgagaatctgaaggaagctgtggactcttcctagaaaaaaaaaccacacatacacatacaatgttgcatgcagtttcaagggattttggacatattgaaacctatcacaggctgtaggttatggacctctgtgccatgagaaaattgatacattaaactaagaactttgtttttaacttaccaatcactactcagcacatcttatataagctgataatttgtgatggaaaaggtctgtagcatgtgatataaggtgaccttatgaatgcctctcttgctggtacattaagttgttttaatatatcatttggaggggactgaaatgttaggctcattacaagcttgatacagaaatatttctgaaggatttctaatcagaattgtaaaacaatgtgctatcatgaaatcgcagtcttcacctcatggttcatggaacatttggttagtcccataaaatcctatgcaaaacaaagtagttcaagaatttttaggtgggtagtcacatttataaggtattcctcttactctttgggctttttcagtctgatttatttaaattttcatttagttgttttacttttggactaaggtgcaatacagtagaagataactttgttacatttatgttgtaggaaaactaaggtgctgtctcctcccccttcccttcccacaaaatctgtattccccctattgctgaaatgtaacagacactacaaattttgtattctttttttgttttttgttttgagacagggtctcactctgtcacccaggctggagggcagtggcgcttcacagctcactgcatcctcaaccttgggggctcacgcagtcctcccgcctcagcctcccaagtagctgggcatgcgccaccaagcccagctaatttttgtatctttagtagagatggggtttcgccatgttgcccaggttggtgtggaattcctgggctccagttatatgcccacctcagcctcccaaagtgctgggattacagacgtgacccaccgcgcctggcgcaaatatgtattcttttaaaatttcctctgatactataagctttttgcatttatctgaagcagtatacatgcctttggtatcagcaattttaacagtttggatatacttatcagctatcttattccaaaactacatctacttcttccagtatagaatctggtgcttcctgaccaaaaagatgagaaaaacaatgttaaaaatatagatgctttccattgaaatggagtgaaaacattggttctatatgttttcttttaaaataattttcttattaaaaacttgctgtctttattatacttaccctttttatgcatatcaatagtatttataagatgtgttctataattatgtaattgtagatactgttatgcattgtccagtgacatcataaggcaggccctactgctgtatcttttctaccttcttatttgtaatagaaactatagaatgtatgactaaaaagtcactttgagattgacttttttaaaaagttattaccttctgctgttgcaaagtgcaaaactgtgagtggaattgttttattctgacttaatgtgttagaaattagagaatacagtgggaggatttttagacattgctgctgctgttacccaaggtattttagataaaaaatttttaataaacatccctttggtatttaaagtggaacatttagcctgttcattttaatctaaagcaaaaagtaatttgggtcaaaatattggtatatttgtaaagcgccttaatatatccctttgtggaaggcactacacagtttacttttatattgtattgtgtatataagtattttgtattaaaattgaatcagtggcaacattaaagttttataaaatcatgctttgttagaaaaagaattacagctttgcaatataactaattgtttcgcataattctgaatgtaatagatatgaataatcagcctgtgtttttaatgaacttatttgtattttcccaatcattttctctagtgtaatgtttgctgggataataaaaaaaattcaaatctttcaa

SEQ ID NO: 2262 - DNA, 5511 bp, Homo sapiens
ttgggtctgcgctttggaaccgcggcgtgagcgccccgggaagatggagcagtcgccgtccacgccaccgccgccgcccggggctcccccgtccctgcggggccagcagcagctccagccaccagtgcccggtctcccggcgcgagaggcccgggagccgccggccaggacgcccccgagggtgtagaccgcgcccctggagagagtgataatcttcaaaatgaagactttggaaaattttaggttctctataggaactacaaaaatggaaggaaagaacattttcaaaaggaaattattttgaaagtatgtttacaacaaactgatactattgacagtttttttttttaaataataaaacactttaagaagattgtatttatggtaaaaggaaactggactaacaatgaggccaaagacttttcctgccacgacttattctggaaatagccggcagcgactgcaagagattcgtgaggggttaaaacagccatccaagtcttcggttcaggggctacccgcaggaccaaacagtgacacttccctggatgccaaagtcctggggagcaaagatgccaccaggcagcagcagcagatgagagccaccccaaagttcggaccttatcagaaagccttgagggaaatcagatattccttgttgccttttgctaatgaatcgggcacctctgcagctgcagaagtgaaccggcaaatgctgcaggaactggtgaacgcaggatgcgaccaggagatggctggccgagctctcaagcagactggcagcaggagcatcgaggccgccctggagtacatcagcaagatgggctacctggacccgaggaatgagcagattgtgcgggtcattaagcagacctccccaggaaaggggctcatgccaaccccagtgacgcggaggcccagcttcgaaggaaccggcgattcgtttgcgtcctaccaccagctgagcggtaccccctacgagggcccaagcttcggcgctgacggccccacggcgctggaggagatgccgcggccgtacgtggactaccttttccccggagtcggcccccacgggcccggccaccagcaccagcacccacccaagggctacggtgccagcgtagaggcagcaggggcacacttcccgctgcagggcgcgcactacgggcggccgcacctgctggtgcctggggaacccctgggctacggagtgcagcgcagcccctccttccagagcaagacgccgccggagaccgggggttacgccagcctgcccacgaagggccagggaggaccgccaggcgccggcctcgctttcccaccccctgccgccgggctctacgtgccgcacccacaccacaagcaggccggtcccgcggcccaccagctgcatgtgctgggctcccgcagccaggtgttcgccagcgacagccccccgcagagcctgctcactccctcgcggaacagcctcaacgtggacctgtatgaattgggcagcacctccgtccagcagtggccggctgccaccctggcccgccgggactccctgcagaagccgggcctggaggcgccgccgcgcgcgcacgtggccttccggcctgactgcccagtgcccagcaggaccaactccttcaacagccaccagccgcggcccggtccgcctggcaaggccgagccctccctgcccgcccccaacaccgtgacggctgtcacggccgcgcacatcttgcacccggtgaagagcgtgcgtgtgctgaggccggagccgcagacggctgtggggccctcgcaccccgcctgggtgcccgcgcctgccccggcccccgcccccgcccccgccccggctgcggagggcttggacgccaaggaggagcatgccctggcgctgggcggcgcaggcgccttcccgctggacgtggagtacggaggcccagaccggaggtgcccgcctccgccctacccgaagcacctgctgctgcgcagcaagtcggagcagtacgacctggacagcctgtgcgcaggcatggagcagagcctccgtgcgggccccaacgagcccgagggcggcgacaagagccgcaaaagcgccaagggggacaaaggcggaaaggataaaaagcagattcagacctctcccgttcccgtccgcaaaaacagcagagacgaagagaagagagagtcacgcatcaagagctactcgccatacgcctttaagttcttcatggagcagcacgtggagaatgtcatcaaaacctaccagcagaaggttaaccggaggctgcagctggagcaagaaatggccaaagctggactctgtgaagctgagcaggagcagatgcggaagatcctctaccagaaagagtctaattacaacaggttaaagagggccaagatggacaagtctatgtttgtcaagatcaaaaccctggggatcggtgcctttggagaagtgtgccttgcttgtaaggtggacactcacgccctgtacgccatgaagaccctaaggaaaaaggatgtcctgaaccggaatcaggtggcccacgtcaaggccgagagggacatcctggccgaggcagacaatgagtgggtggtcaaactctactactccttccaagacaaagacagcctgtactttgtgatggactacatccctggtggggacatgatgagcctgctgatccggatggaggtcttccctgagcacctggcccggttctacatcgcagagctgactttggccattgagagtgtccacaagatgggcttcatccaccgagacatcaagcctgataacattttgatagatctggatggtcacattaaactcacagatttcggcctctgcactgggttcaggtggactcacaattccaaatattaccagaaagggagccatgtcagacaggacagcatggagcccagcgacctctgggatgatgtgtctaactgtcggtgtggggacaggctgaagaccctagagcagagggcgcggaagcagcaccagaggtgcctggcacattcactggtggggactccaaactacatcgcacccgaggtgctcctccgcaaagggtacactcaactctgtgactggtggagtgttggagtgattctcttcgagatgctggtggggcagccgccctttttggcacctactcccacagaaacccagctgaaggtgatcaactgggagaacacgctccacattccagcccaggtgaagctgagccctgaggccagggacctcatcaccaagctgtgctgctccgcagaccaccgcctggggcggaatggggccgatgacctgaaggcccaccccttcttcagcgccattgacttctccagtgacatccggaagcagccagccccctacgttcccaccatcagccaccccatggacacctcgaatttcgaccccgtagatgaagaaagcccttggaacgatgccagcgaaggtagcaccaaggcctgggacacactcacctcgcccaataacaagcatcctgagcacgcattttacgaattcaccttccgaaggttctttgatgacaatggctacccctttcgatgcccaaagccttcaggagcagaagcttcacaggctgagagctcagatttagaaagctctgatctggtggatcagactgaaggctgccagcctgtgtacgtgtagatgggggccaggcacccccaccactcgctgcctcccaggtcagggtcccggagccggtgccctcacaggccaatagggaagccgagggctgttttgttttaaattagtccgtcgattacttcacttgaaattctgctcttcaccaagaaaacccaaacaggacacttttgaaaacaggactcagcatcgctttcaataggcttttcaggaccttcactgcattaaaacaatatttttgaaaatttagtacagtttagaaagagcacttattttgtttatatccattttttcttactaaattatagggattaactttgacaaatcatgctgctgttattttctacatttgtattttatccatagcacttattcacatttaggaaaagacataaaaactgaagaacattgatgagaaatctctgtgcaataatgtaaaaaaaaaaaaagataacactctgctcaatgtcacggagaccattttatccacacaatggtttttgttttttattttttcccatgtttcaaaattgtgatataatgatataatgttaaaagctgctttttttggctttttgcatatctagtataataggaagtgtgagcaaggtgatgatgtggctgtgatttccgacgtctggtgtgtggagagtactgcatgagcagagttcttctattataaaattaccatatcttgccattcacagcaggtcctgtgaatacgtttttactgagtgtctttaaatgaggtgttctagacagtgtgctgataatgtattgtgcgggtgacctcttcgctatgattgtatctcttactgttttgttaaagaaatgcagatgtgtaactgagaagtgatttgtgtgtgtgtcttggttgtgattggattctttggggggggggaactgaaacatttgtcatatactgaacttatatacatcaaaagggattaatacagcgatgccaaaaagtttaatcacggacacatgtccgtttctgtagtccgtatgctctttcattcttggtagagctggtatgtggaatgccatacctctgaccctactacttacctttttactgacagactgcccacactgaaagcttcagtgaatgttcttagtcctgttttcttctgttactgtcaggaaactgagtgatctaatggttctctcactttttttttgttcttttagtgtactttgaagtatcaaatcttaacttggtttaaacaatacatattcctaacctttgtaaaaaagcaaagattcttcaaaatgacattgaaataaaaagtaagccatacgtattttcttagaagtatagatgtatgtgcgtgtatacacacacacacacacacacagagataaacacaatattccttatttcaaattagtatgattcctatttaaagtgatttatatttgagtaaaaagttcaattcttttttgctttttaaaaaatctgatgcttcataattttcattatattattccacatatttttccttgaagttcttagcataatgtatccattacttagtatatatctaggcaacaacacttagaagtttatcagtgtttaaactaaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagcttctactggcacaatttattattaaaattttgaatccaaatccc

SEQ ID NO: 2263 - DNA, 3632 bp, Homo sapiens
acatcttgccatcacatccttcagcccaactccagaacttctggggagctttccctcggggatggagtgcggcctggagcaaacccgtttgtgaaatgcaagtctccagtgtcccgagggttgggaacggggggcgaggcgaggaatggaccctgaagaagagagtgataatcttcaaaatgaagactttggaaaattttaggttctctataggaactacaaaaatggaaggaaagaacattttcaaaaggaaattattttgaaagtatgtttacaacaaactgatactattgacagtttttttttttaaataataaaacactttaagaagattgtatttatggtaaaaggaaactggactaacaatgaggccaaagacttttcctgccacgacttattctggaaatagccggcagcgactgcaagagattcgtgaggggttaaaacagccatccaagtcttcggttcaggggctacccgcaggaccaaacagtgacacttccctggatgccaaagtcctggggagcaaagatgccaccaggcagcagcagcagatgagagccaccccaaagttcggaccttatcagaaagccttgagggaaatcagatattccttgttgccttttgctaatgaatcgggcacctctgcagctgcagaagtgaaccggcaaatgctgcaggaactggtgaacgcaggatgcgaccaggagatggctggccgagctctcaagcagactggcagcaggagcatcgaggccgccctggagtacatcagcaagatgggctacctggacccgaggaatgagcagattgtgcgggtcattaagcagacctccccaggaaaggggctcatgccaaccccagtgacgcggaggcccagcttcgaaggaaccggcgattcgtttgcgtcctaccaccagctgagcggtaccccctacgagggcccaagcttcggcgctgacggccccacggcgctggaggagatgccgcggccgtacgtggactaccttttccccggagtcggcccccacgggcccggccaccagcaccagcacccacccaagggctacggtgccagcgtagaggcagcaggggcacacttcccgctgcagggcgcgcactacgggcggccgcacctgctggtgcctggggaacccctgggctacggagtgcagcgcagcccctccttccagagcaagacgccgccggagaccgggggttacgccagcctgcccacgaagggccagggaggaccgccaggcgccggcctcgctttcccaccccctgccgccgggctctacgtgccgcacccacaccacaagcaggccggtcccgcggcccaccagctgcatgtgctgggctcccgcagccaggtgttcgccagcgacagccccccgcagagcctgctcactccctcgcggaacagcctcaacgtggacctgtatgaattgggcagcacctccgtccagcagtggccggctgccaccctggcccgccgggactccctgcagaagccgggcctggaggcgccgccgcgcgcgcacgtggccttccggcctgactgcccagtgcccagcaggaccaactccttcaacagccaccagccgcggcccggtccgcctggcaaggccgagccctccctgcccgcccccaacaccgtgacggctgtcacggccgcgcacatcttgcacccggtgaagagcgtgcgtgtgctgaggccggagccgcagacggctgtggggccctcgcaccccgcctgggtgcccgcgcctgccccggcccccgcccccgcccccgccccggctgcggagggcttggacgccaaggaggagcatgccctggcgctgggcggcgcaggcgccttcccgctggacgtggagtacggaggcccagaccggaggtgcccgcctccgccctacccgaagcacctgctgctgcgcagcaagtcggagcagtacgacctggacagcctgtgcgcaggcatggagcagagcctccgtgcgggccccaacgagcccgagggcggcgacaagagccgcaaaagcgccaagggggacaaaggcggaaaggataaaaagcagattcagacctctcccgttcccgtccgcaaaaacagcagagacgaagagaagagagagtcacgcatcaagagctactcgccatacgcctttaagttcttcatggagcagcacgtggagaatgtcatcaaaacctaccagcagaaggttaaccggaggctgcagctggagcaagaaatggccaaagctggactctgtgaagctgagcaggagcagatgcggaagatcctctaccagaaagagtctaattacaacaggttaaagagggccaagatggacaagtctatgtttgtcaagatcaaaaccctggggatcggtgcctttggagaagtgtgccttgcttgtaaggtggacactcacgccctgtacgccatgaagaccctaaggaaaaaggatgtcctgaaccggaatcaggtggcccacgtcaaggccgagagggacatcctggccgaggcagacaatgagtgggtggtcaaactctactactccttccaagacaaagacagcctgtactttgtgatggactacatccctggtggggacatgatgagcctgctgatccggatggaggtcttccctgagcacctggcccggttctacatcgcagagctgactttggccattgagagtgtccacaagatgggcttcatccaccgagacatcaagcctgataacattttgatagatctggatggtcacattaaactcacagatttcggcctctgcactgggttcaggtggactcacaattccaaatattaccagaaagggagccatgtcagacaggacagcatggagcccagcgacctctgggatgatgtgtctaactgtcggtgtggggacaggctgaagaccctagagcagagggcgcggaagcagcaccagaggtgcctggcacattcactggtggggactccaaactacatcgcacccgaggtgctcctccgcaaagggtacactcaactctgtgactggtggagtgttggagtgattctcttcgagatgctggtggggcagccgccctttttggcacctactcccacagaaacccagctgaaggtgatcaactgggagaacacgctccacattccagcccaggtgaagctgagccctgaggccagggacctcatcaccaagctgtgctgctccgcagaccaccgcctggggcggaatggggccgatgacctgaaggcccaccccttcttcagcgccattgacttctccagtgacatccggaagcagccagccccctacgttcccaccatcagccaccccatggacacctcgaatttcgaccccgtagatgaagaaagcccttggaacgatgccagcgaaggtagcaccaaggcctgggacacactcacctcgcccaataacaagcatcctgagcacgcattttacgaattcaccttccgaaggttctttgatgacaatggctacccctttcgatgcccaaagccttcaggagcagaagcttcacaggctgagagctcagatttagaaagctctgatctggtggatcagactgaaggctgccagcctgtgtacgtgtag

SEQ ID NO: 2264 - DNA, 1278 bp, Homo sapiens
tggtcaccagggaagctggcaagggaagggagactagggtgcgctctaggagaagccgacagcctgagagtcccagaagaggagccctgtggaccctcccctgccagccactcccttaccctgggtataagagccaccaccgcctgccatccgccaccatctcccactcctgcagctcttctcacaggaccagccactagcgcagcctcgagcgatggcctatgtccccgcaccgggctaccagcccacctacaacccgacgctgccttactaccagcccatcccgggcgggctcaacgtgggaatgtctgtttacatccaaggagtggccagcgagcacatgaagcggttcttcgtgaactttgtggttgggcaggatccgggctcagacgtcgccttccacttcaatccgcggtttgacggctgggacaaggtggtcttcaacacgttgcagggcgggaagtggggcagcgaggagaggaagaggagcatgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtgtctcatg

SEQ ID NO: 2265 - DNA, 1949 bp, Homo sapiens
gtggtttctaacgctgaacttaaaaagtgttgagatgaataatgaagaggaccttctgcaggaggactcaacaagagatgaaggcaatgagactgaagccaacagcatgaacacattaagaaggacaaggaagaaagtcactaaaccatatgtttgttcaactgaagtgggagaaacggatatgtccaattcaaatgattgcatgagggacagcagtcaaattttgaccccacctcaactctcttctagaatgaaacacattagacaagccatggccaaaaatcgcctccagtttgtacgatttgaagcaacagacctccacggcgtgtccaggtctaagactatccctgcacacttttttcaagagaaagtgagccatggtgtttgcatgccccgaggttatcttgaagtgataccaaatccaaaggacaatgaaatgaataacataagagccacatgttttaatagcgacatagtcctaatgccagagttatcaacctttagagttttgccatgggctgacagaactgcaagagtgatatgtgataccttcactgtgactggtgagcctcttttgacttccccaaggtacattgcaaagaggcagctgagccatctgcaggcctctggcttttccctgctttctgctttcatctatgatttttgcatttttggtgtgcccgaaattttaaattcaaagattatatcttttcctgctttaacatttttaaataaccatgatcagcccttcatgcaggaacttgttgatggcttgtatcacactggagccaatgtcgagagtttttcctcctctaccaggcctggtcagatggaaatctctttcctgcctgaatttggcattagctcagctgataatgcatttaccctcagaacaggtgtcaaagaagtggcaaggaaatataattacattgccagcttcttcattgagactggattttgtgattcagggattttgtctcatagtctctgggatgtcgataggaagaaaaacatgttctgcagcacttctggaactgagcagctcacgatcactgggaaaaaatggttggcaggactcttgaagcactctgctgcgctcagctgcctgatggcgccttctgttagctgccgaaagcgttattccaaggacaggaaagacctgaagaagagtgtgcctacaacatggggatacaatgacaacagctgtatatttaatatcaaatgtcatggagagaaaggcacccggatagaaaataaactaggctcagcaacagcaaacccttacttggtgctggctgcaactgttgctgccggcttagatggacttcatagcagtaatgaggtcttggctggtccagatgagagcacagacttttaccaagtggaaccttctgagatccctttaaaactagaagatgcccttgtggcactggaagaagatcaatgcctgagacaggctctaggagaaacctttattcgatattttgttgccatgaagaaatatgagttggagaatgaagaaatagctgcagagagaaataaattcttagagtattttatttagaatagagctcacaactactcctttagacatgtaattgttacttaaagctaatctaccaaaacaaaaagactgaacttttgtaattaacaacagcaacaataacaagattacgaatgcttttgacttttttttttgtccatggaatatttgacagatgaagtaggactgctgagaagattctgataacagaaacaaacaacaaagttgtggtgaagctataatatgcaaacttaccagatcttgtcagtcatttcctatgtgtatgttgacctggataagaatatccaattttgggtggcaataaatatattcgcacattaagaaaaaaaagacttaagcattagaaagcaaaatttaaatgactaaaaaagaaaaaaaagaaaag

SEQ ID NO: 2266 - DNA, 5213 bp, Homo sapiens
gtggtttctaacgctgaacttaaaaagtgttgagatgaataatgaagaggaccttctgcaggaggactcaacaagagatgaaggcaatgagactgaagccaacagcatgaacacattaagaaggacaaggaagaaagtcactaaaccatatgtttgttcaactgaagtgggagaaacggatatgtccaattcaaatgattgcatgagggacagcagtcaaattttgaccccacctcaactctcttctagaatgaaacacattagacaagccatggccaaaaatcgcctccagtttgtacgatttgaagcaacagacctccacggcgtgtccaggtctaagactatccctgcacacttttttcaagagaaagtgagccatggtgtttgcatgccccgaggttatcttgaagtgataccaaatccaaaggacaatgaaatgaataacataagagccacatgttttaatagcgacatagtcctaatgccagagttatcaacctttagagttttgccatgggctgacagaactgcaagagtgatatgtgataccttcactgtgactgtctctgggatgtcgataggaagaaaaacatgttctgcagcacttctggaactgagcagctcacgatcactgggaaaaaatggttggcaggactcttgaagcactctgctgcgctcagctgcctgatggcgccttctgttagctgccgaaagcgttattccaaggacaggaaagacctgaagaagagtgtgcctacaacatggggatacaatgacaacagctgtatatttaatatcaaatgtcatggagagaaaggcacccggatagaaaataaactaggctcagcaacagcaaacccttacttggtgctggctgcaactgttgctgccggcttagatggacttcatagcagtaatgaggtcttggctggtccagatgagagcacagacttttaccaagtggaaccttctgagatccctttaaaactagaagatgcccttgtggcactggaagaagatcaatgcctgagacaggctctaggagaaacctttattcgatattttgttgccatgaagaaatatgagttggagaatgaagaaatagctgcagagagaaataaattcttagagtattttatttagaatagagctcacaactactcctttagacatgtaattgttacttaaagctaatctaccaaaacaaaaagactgaacttttgtaattaacaacagcaacaataacaagattacgaatgcttttgacttttttttttgtccatggaatatttgacagatgaagtaggactgctgagaagattctgataacagaaacaaacaacaaagttgtggtgaagctataatatgcaaacttaccagatcttgtcagtcatttcctatgtgtatgttgacctggataagaatatccaattttgggtggcaataaatatattcgcacattaagaaaaaaaagacttaagcattagaaagcaaaatttaaatgactaaaaaagaaaaaaaagaaaaggagaaaaaattttaatggtacacataggttatgatttccagggagacaaatatactaatatagtctcgctaatcaaataatattgtgaatccaggttgtatgcaccattatggtctttctaaacaagttaaataaacttttgccaaaatataatgacaggtaggcagttttcccctaagtctcttctcttttcacccttctccactagctcctgaaaagcttatgaacttcaaggttataatgtcctcaagaaacaaatccctaaggaatagaattggagctgagaacaacgaggtcagattttaaaagtagttaaagcctttcttttaacaatgcctcatatagaagttcaatacacaaagtatagatagaaagatgtttgtgtgtgagggtaggtgggctctgtctactctgcttcattctttgaaactagatgttcctctgaaacctctagtgctctgtggagtgtgagaacaactgcctggctagccagggctatgtttggagtttaagtttgttattcaaattactgaatctgctgctcacagaggttggtacctccccagagaatattacctgttccaggcctttgtttgaatgagataatattgtaactatcacaaaagtttagctgcttttgggaagaagtccaaaatccacttactagcaaatgaaacattattctactgcttaggatcaaacagcagattttatgttcaattaaaactgactgtagtctcaatttagatagcaattgcacaagcagaggattagaatttggctcagatcctcttattaaaattcatattactcagtagcttaaatagtgaaagtcagtctatccttcactaattactcccttcttttttcctttgagcaggagaagtgtgtttggatacataagaagaaagttcccagcactttgggaggccaaggcaggaggattgcttgaggccaggagtttgagtccagcctggaccacatagtgagacccctgtttctacaaaaaaaaaaaaaaaaatgcctcgcatggtggcacatgcctgtagtcccagctacgtgggaggctgagaagggaggatcgcttgagcctgggagtttcaggctgcagtgagccataatcacaccactgcactccagcttgggtgacagagtgagacactgtcttaaaaaaaagagaagaataaaattcatggatgcatatggggtagagagaaagatagtgtagggtagctgggggaaggaagggaacctgtcctgaaacctccagaatgaaatcccacacattacatcatgggagggataaggaagactctcatgccaattttctagctgtctgctagaaaattcccctctgttcattttcccctctgttctcagtaataaaacctcaatatgttctttgaaagcaatgaaaaatgaaatgatatttctgagccttcattaaggttggatgtggtcatgttattaggttcagtgcaaagaggtgaaagtagaagtgttgcatataagttctttaggacattttcttttcttttcttgtattttttttttttttccgagatggagtctcgctttgtcacccaggctgaagtgcaatgtgggggggtcttggctcactgcaacctctgccccctgggttcaagtaattctcctgcctcagcctcccaagtagctgggatcccaggtgcctgctaccatgcctggccttttagtagagatggggtttcaccatattggccagtctggtcttgaactcctgaactcaggtgatcagcctgccttggcctcccaaagtgctaggattacaggcatgagccaccatgccctaccacactttagaacatttttttaaatgacggatgctgtgtgctctgccctttctttctcttgctgccttcacccttcctgctgagtggcctacagataatgtggctaggattatgtccttgggaagggaggtttgctccacagggtacagtaataaggtggaatctctgctttgtagagcagtttgacttgcctacatccagatgtttacctgagagagaaccaaacttctatcttctttaagccacaatgattttgattctttgttagttgcaatgaaatttattttctcttttccatgtgtgtgttgtatgtgtgtttgtgtgtgagtgtgtgcatatgagtggggaatttgagggatttggggatgaaagaacaaaggtataagaaccagtgaaagacgacttcctcaatattcccacttctagagaggataatctgagttaatcaaagggatccacacatccaaaaaatgggattggctctaacccatccctataaagtggcatatccctttatagtccacgggccttaatgaaacatgtctaatgcattgacttcattttaccataatgagtaaagatgctgtaaaaagtctgataatcacagtgtttgaagccgttttttcccctttcgcattattagcataacttaaaaacacagtactcaggatgccatgtgaaggaattatataactaggaatattatcttcagtattaagtgtacagtcgtgagtcaaagaaaatattcagccatagattacaaatcagttgataacgtaagttggtgtggcagtttccaccaagatttcagttaggtgtgtgctgatgtatattcttgttctttaaggcaacccaaaaagaggcattggccagcagagttcagggccaaagacaaattggggtaggtacatgtaaaaatcagttatctatttttctatttctttcatctgttcataggctttctattgttgaaaggactttctgctgatgcttctaccttcttggtctgggttaagagggtcagacattcattcagcagcacttattgagcaccatttgtgtgctaagccttcagctgggagccatcatactaggggagaccaaaacaaagatgagcagacaatgaaagagttttggatctgtgtatcttaagcagaacataaataattttttttgtagacctaatgctgaaaaaagctatttggaaagcttctttatggctcgaaaagggtgccttataaatagctttacaaaaattgctttcttattttcatttactataattgttctaatcaaagcttaggggaaaaatgtgattactgaatttaaagttggtaattaaatgagtatacataagaaatgtaaattaaaagcgataatattttaagactagaaattaaaacattagtattgtagtaacaagtttctattttcaaggacattctataatctaaaatttcattttacagtgtgtgaataacaacaacgcttgaaatgattatttgaaggcaatgaaagatcaaaaaactttaatctgaataaaaattgaaagcatacagtgaagtctgagcttatcagtaaaacagaacagtctattgacatatctccagtcacctgtttgacaaaatacactcaccaatatgtttatgatataggtatgactggacaatacctttaaccttgggttttctatgacaggggtaagaatttgtgtctttaaacattacctatgtgcacagtgccttccctgttaaagctcttctcatgctgcctataattaggggtttacatgatacttcctaattgctaattaggatgtgaattctcagaataaaaggtacagatcttactta

SEQ ID NO: 2267 - DNA, 3420 bp, Homo sapiens
atcgcagcgccagcggttgcaaggcccaagaagcccatcctgggaaggaaaatgcattggggaaccctgtgcggattcttgtggctttggccctatcttttctatgtccaagctgtgcccatccaaaaagtccaagatgacaccaaaaccctcatcaagacaattgtcaccaggatcaatgacatttcacacacgcagtcagtctcctccaaacagaaagtcaccggtttggacttcattcctgggctccaccccatcctgaccttatccaagatggaccagacactggcagtctaccaacagatcctcaccagtatgccttccagaaacgtgatccaaatatccaacgacctggagaacctccgggatcttcttcacgtgctggccttctctaagagctgccacttgccctgggccagtggcctggagaccttggacagcctggggggtgtcctggaagcttcaggctactccacagaggtggtggccctgagcaggctgcaggggtctctgcaggacatgctgtggcagctggacctcagccctgggtgctgaggccttgaaggtcactcttcctgcaaggactacgttaagggaaggaactctggcttccaggtatctccaggattgaagagcattgcatggacaccccttatccaggactctgtcaatttccctgactcctctaagccactcttccaaaggcataagaccctaagcctccttttgcttgaaaccaaagatatatacacaggatcctattctcaccaggaagggggtccacccagcaaagagtgggctgcatctgggattcccaccaaggtcttcagccatcaacaagagttgtcttgtcccctcttgacccatctccccctcactgaatgcctcaatgtgaccaggggtgatttcagagagggcagaggggtaggcagagcctttggatgaccagaacaaggttccctctgagaattccaaggagttccatgaagaccacatccacacacgcaggaactcccagcaacacaagctggaagcacatgtttatttattctgcattttattctggatggatttgaagcaaagcaccagcttctccaggctctttggggtcagccagggccaggggtctccctggagtgcagtttccaatcccatagatgggtctggctgagctgaacccattttgagtgactcgagggttgggttcatctgagcaagagctggcaaaggtggctctccagttagttctctcgtaactggtttcatttctactgtgactgatgttacatcacagtgtttgcaatggtgttgccctgagtggatctccaaggaccaggttattttaaaaagatttgttttgtcaagtgtcatatgtaggtgtctgcacccaggggtggggaatgtttgggcagaagggagaaggatctagaatgtgttttctgaataacatttgtgtggtgggttctttggaaggagtgagatcattttcttatcttctgcaattgcttaggatgtttttcatgaaaatagctctttcaggggggttgtgaggcctggccaggcaccccctggagagaagtttctggccctggctgaccccaaagagcctggagaagctgatgctttgcttcaaatccatccagaataaaacgcaaagggctgaaagccatttgttggggcagtggtaagctctggctttctccgactgctagggagtggtctttcctatcatggagtgacggtcccacactggtgactgcgatcttcagagcaggggtccttggtgtgaccctctgaatggtccagggttgatcacactctgggtttattacatggcagtgttcctatttggggcttgcatgccaaattgtagttcttgtctgattggctcacccaagcaaggccaaaattaccaaaaatcttggggggtttttactccagtggtgaagaaaactcctttagcaggtggtcctgagacctgacaagcactgctaggcgagtgccaggactccccaggccaggccaccaggatggcccttcccactggaggtcacattcaggaagatgaaagaggaggtttggggtctgccaccatcctgctgctgtgtttttgctatcacacagtgggtggtggatctgtccaaggaaacttgaatcaaagcagttaactttaagactgagcacctgcttcatgctcagccctgactggtgctataggctggagaagctcacccaataaacattaagattgaggcctgccctcagggatcttgcattcccagtggtcaaaccgcactcacccatgtgccaaggtggggtatttaccacagcagctgaacagccaaatgcatggtgcagttgacagcaggtgggaaatggtatgagctgaggggggccgtgcccaggggcccacagggaaccctgcttgcactttgtaacatgtttacttttcagggcatcttagcttctattatagccacatccctttgaaacaagataactgagaatttaaaaataagaaaatacataagaccataacagccaacaggtggcaggaccaggactatagcccaggtcctctgatacccagagcattacgtgagccaggtaatgagggactggaaccagggagaccgagcgctttctggaaaagaggagtttcgaggtagagtttgaaggaggtgagggatgtgaattgcctgcagagagaagcctgttttgttggaaggtttggtgtgtggagatgcagaggtaaaagtgtgagcagtgagttacagcgagaggcagagaaagaagagacaggagggcaagggccatgctgaagggaccttgaagggtaaagaagtttgatattaaaggagttaagagtagcaagttctagagaagaggctggtgctgtggccagggtgagagctgctctggaaaatgtgacccagatcctcacaaccacctaatcaggctgaggtgtcttaagccttttgctcacaaaacctggcacaatggctaattcccagagtgtgaaacttcctaagtataaatggttgtctgtttttgtaacttaaaaaaaaaaaaaaaagtttggccgggtgcggtggctcacgcctgtaatcccagcactttgggaggccaaggtggggggatcacaaggtcactagatggcgagcatcctggccaacatggtgaaaccccgtctctactaaaaacacaaaagttagctgagcgtggtggcgggcgcctgtagtcccagccactcgggaggctgagacaggagaatcgcttaaacctgggaggcggagagtacagtgagccaagatcgcgccactgcactccggcctgatgacagagcgagattccgtcttaaaaaaaaaaaaaaaaaagtttgtttttaaaaaaatctaaataaaataactttgccccctg

SEQ ID NO: 2268 - DNA, 5459 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctgcgggccgagctgcgggaggagcggcaaggccatgaccagatgtcctcgggcttccagcatgagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctttgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagtacagcggctcccctctgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccaggcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatcctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccctcta

SEQ ID NO: 2269 - DNA, 231 bp, Homo sapiens
atgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaaggccatgaccagatgtcctcgggcttccagcatgagcggctcgtgtggaaggaggagaaggagaaggtga

SEQ ID NO: 2270 - DNA, 1833 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctga

SEQ ID NO: 2271 - DNA, 5706 bp, Homo sapiens
gcagaggccggcgcgcctggagctggcgggttggcagcggccgggcggggaggccgaaagtttctctgcccgcctcggccagtgagtgggagccgggagctgcatcccgcgcagtgggaccggcccggcccgctcagcagctctggaaaaagagagacgggaacacaccgggaaacactgggaaaaaaaaaaagtctcaagtgcgcccgaggcgcagggggcaggtctacggctctcgcaggctctgtgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctgcgggccgagctgcgggaggagcggcaaggccatgaccagatgtcctcgggcttccagcatgagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctttgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagtacagcggctcccctctgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccaggcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatcctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccctcta

SEQ ID NO: 2272 - DNA, 1614 bp, Homo sapiens
atgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaagcatgagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctga

SEQ ID NO: 2273 - DNA, 1410 bp, Homo sapiens
gccctgcacgtcggggcagcgggacagatcccagggtgcccagggagtctccaagtgcctcactcctcccgccgcaaacatgacagagaactccgacaaagttcccattgccctggtgggacctgatgacgtggaattctgcagccccccggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatccagagggaaagaagagaagtggtaagaaaaattgttccaactaccacaaaaagaccacacagtggaccacggagcaacccaggcgctggaagactgaataatgaaaccagacccagtgttcaagaggactcacaagccttcaatcctgataatccttatcatcagcaggaaggggaaagcatgacattcgaccctagactggatcacgaaggaatctgttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggtgtgaaatcacttcatatatcatgtgctgtaaaataagaactagctgaagagacaaccaaagaagcattaaggcaggttgatgctgataggaccacaaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgcc

SEQ ID NO: 2274 - DNA, 731 bp, Homo sapiens
ccgactgcaaaggaccctcgggagggagcgcggcgaaaggggcacccgtaggagcccgggcgagctgtttcccgcccgactccccactccctgggggctaccgcgtggggcccgggtgcgctgggggccgcaggtgctggcggcacaaacgcgacggtccctctcccgccccggcccgcaggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaag

SEQ ID NO: 2275 - DNA, 1444 bp, Homo sapiens
ccgtgcaccgtgtgtgcgcgcggcgttgaaatgccctgcacgtcggggcagcgggacagatcccagggtgcccagggagtctccaagtgcctcactcctcccgccgcaaacatgacagagaactccgacaaagttcccattgccctggtgggacctgatgacgtggaattctgcagccccccggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatccagagggaaagaagagaagtggtaagaaaaattgttccaactaccacaaaaagaccacacagtggaccacggagcaacccaggcgctggaagactgaataatgaaaccagacccagtgttcaagaggactcacaagccttcaatcctgataatccttatcatcaggaaggggaaagcatgacattcgaccctagactggatcacgaaggaatctgttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggtgtgaaatcacttcatatatcatgtgctgtaaaataagaactagctgaagagacaaccaaagaagcattaaggcaggttgatgctgataggaccacaaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgccaaaaa

SEQ ID NO: 2276 - DNA, 1464 bp, Homo sapiens
attttgaaaccagtgcagtaatcaggtgtctgagccctttaggtcagctaattagtggcaaactttaaaaaagaaatgttttaagtattgaaatttgtctttctaacaaaatgttactcagaaatgcaacacataagacagaaaaagcagagccactctggttagactatggatggacaggagagaacagagtgccacagtgccatcctcacctctaggccatgcccgggagatcccaacagttctaaggacatagatgaaagccacctatgaggtccaacttcattatacactcgtggcaactcacaagatccagagatgagtggtgtggccacctgttttcctgattactggaccgatgctcttctgcagtgccaggtcccttcccctcttccacactccccacacatctcataacaaaatgccctacagcaccatgggcctgccccatagaatcgttcagggagtactaccattttgagctgaaacaaacatgcacattggccttcctctccacacatgctgctctatatcaagcataccctggtcctgtctgcagtcctttccatatacctaataccatataccatatacctgagacactgcatgcctaatcttgaccaaaggatgaaaacaacttgtgaaactgaggtgccactgcagacgtgttcagctgggagcccaattaaccttctgcctcctcaatttccatttatccatcaatagtgctcaacccagatgcataatagaattgagctttagaaaaagaaagacctatgcccaagcgcccttcccacagcttctgatttgatttgtccagggtgaaacccaggcatggtacccagagagtctacccagatgcttctaaagtacagccagcattgcaaattatggagctattggaataggtgtcagaggcaaccaaagtctttactcttaaggtatttttaaggaaatcattgcattaactgattgttgtatgaatgaagtcatcatatataatgtattattattaaggactatctcatgtatctctgaaacatatggacactacctcatacactgcccttctaagataagccctgaattgctcaaaaaagaaagcatcactaactcttatgctcactttcagatttacaatgtccattacaccatgagtatcaatgggaaattacaagatgggtcaatggaaatagacgctgggaacaacttggagacctttaaaatgggaagtggagctgaagaagcaattgcagttaatgatttccagaatgtaagtatatttcatgcatttagagaatttaaccaggcaagcctgcgggacttttctaattcaaggaggagcagcgtttctcacacacatccaaatggtaactgttctttatagcagttgtagtgccactaatccactacatgtagcatattctctctgagaaaggaccagactttgtccttcatatttgc

SEQ ID NO: 2277 - DNA, 3083 bp, Homo sapiens
cagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggatagct

SEQ ID NO: 2278 - DNA, 3027 bp, Homo sapiens
agacgtctgcgcgcgaatgccgtggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggat

SEQ ID NO: 2279 - DNA, 2886 bp, Homo sapiens
acttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaagcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggat

SEQ ID NO: 2280 - DNA, 1527 bp, Homo sapiens
tggcgcgaacttgggactgcagaggcgcgcctggcggatctgagtgtgttgcccgggcagcggcgcgcgggaccaacgcaaggagcagctgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggccgcgagagaagggagacacgcagccacaactgtcaccctcgacacccccacccgcgctctcccctgaaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgccc

SEQ ID NO: 2281 - DNA, 4055 bp, Homo sapiens
gtgtgttgcccgggcagcggcgcgcgggaccaacgcaaggcaagactgacagacgaagaaaagtgctggacaggaagggagaattctgacgccaacatgcagcgaagtatcatgtcatttttccaccccaagaaagagggtaaagcaaagaagcctgagaaggaggcatccaatagcagcagagagacggagccccctccaaaggcggcactgaaggagtggaatggagtggtgtccgagagtgactctccggtgaagaggccagggaggaaggcggcccgggtcctgggcagcgaaggggaagaggaggatgaagcccttagccctgctaaaggccagaagcctgccctggactgctcacaggtctccccgccccgtcctgccacatctcctgagaacaatgcttccctctctgacacctctcccatggacagttccccatcagggattccgaagcgtcgcacagctcggaagcagctcccgaaacggaccattcaggaagtcctggaagagcagagtgaggacgaggacagagaagccaagaggaagaaggaggaggaagaggagaccccgaaagaaagcctcacagaggctgaagtggccacagagaaggaaggagaagacggggaccagcccaccacgcctcccaagcccctaaagacctccaaagcagagaccccgacggaaagcgtttcagagcctgaggtggccacgaagcaggaactgcaggaggaggaagagcagaccaagcctccccgcagagctcccaagacgctcagcagcttcttcaccccccggaagccagcagtcaaaaaagaagtgaaggaagaggagccaggggctccaggaaaggagggagctgctgagggacccctggatccatctggttacaatcctgccaagaacaactatcatcccgtggaagatgcctgctggaaaccgggccagaaggttccttacctggctgtggcccggacgtttgagaagatcgaggaggtgtctgctcggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgcttccacagccaagaagatagacatcatcaaaggcctctttgtggcctgccgccactcagaagcccggttcatcgctaggtccctgagcggacggctgcgccttgggctggcagagcagtcggtgctggctgccctctcccaggcagtgagcctcacgcccccgggccaagaattcccaccagccatggtggatgctgggaagggcaagacagcagaggccagaaagacgtggctggaggagcaaggcatgatcctgaagcagacgttctgcgaggttcccgacctggaccgaattatccccgtgctgctggagcacggcctggaacgtctcccggagcactgcaagctgagcccagggattcccctgaaaccaatgttggcccatcccacccggggcatcagcgaggtcctgaaacgctttgaggaggcagctttcacctgcgaatacaaatatgacgggcagagggcacagatccacgccctggaaggcggggaggtgaagatcttcagcaggaatcaggaagacaacactgggaagtacccggacatcatcagccgcatccccaagattaaactcccatcggtcacatccttcatcctggacaccgaagccgtggcttgggaccgggaaaagaagcagatccagccattccaagtgctcaccacccgcaaacgcaaggaggtggatgcgtctgagatccaggtgcaggtgtgtttgtacgccttcgacctcatctacctcaatggagagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaagactcctgcgaggggctgatggtgaagaccctggatgttgatgccacctacgagatcgccaagagatcgcacaactggctcaagctgaagaaggactaccttgatggcgtgggtgacaccctggacctggtggtgatcggcgcctacctgggccgggggaagcgggccggccggtacgggggcttcctgctggcctcctacgacgaggacagtgaggagctgcaggccatatgcaaggtcctggggaactggggctgatggcagaagcaggagggaaggagattagactcccgggggtatttcctattgcacaacccagaccgaggggtgctcacatccccctgtgaaggatccgttctccccagtttttatttactttttctggttctatgagcaactcttgcttcatatagaaaaacaggctgggatagaaagatgtcaggaatgtgtgtcagtgagagattgagattagctacaaatagtggtggctcacataagaaaagaatttttttgttatgaaatgagaagtgtggagggggcagtctgatgccattagggattcaggttcctcctctccccacatttttttttgtccccacattttttttttctgccatgtgcctctggcctcatcatcacaatgtggctgcaggagttccagccctcatggccatgcctgctccacgcaccagggaagagcaaagggggttggaccctgagtcagcctcagccagtgaacaccttctgctcaagttctgttgctcatcactttgctccatggctcacccctagctgcaaggaattctgggaaatgtaaagtgatttactttttttcaagttaaagtttttcttaaagctgtgcacattttggactagattttcttacgtatttcctatattcccctctccaacaaatttgggtcttttgccacagaaacagaacaaaatatcacctagaatcgtaccacccagagacacgcagtagtgacatttgagggaatgttttatttacatttttgcaaagttgtgatccttctctatgagtaattttcttttctgcctttttaccctggaagtactttgttttcagtgttgtatatgcccttaagcaatatggcaacaggacctgaatgcccgcacaagagttttcaagtgctgtgccccatagcacatagtgctgtgtcctgaaccagctccccgtggctgtgtggggaagttgttgccggctttgttctgatggcttggaactggcttcagtgatgaggagctggaggagcatcaccagagcctcaaggcgctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtggatagtgacaagggcatctcccttcgcttccctcggtttattcgagtccgtgaagacaagcagccggagcaggccaccaccagtgctcaggtggcctgtttgtaccggaagcaaagtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattattggat

SEQ ID NO: 2282 - DNA, 3020 bp, Homo sapiens
caaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaagaggcggccagccagtgagcagagaggaagaactgtgccagcaggcaggagatagaacagcccggcctagccaggagagactgcagggactcactcagctgctggccccaagtcaaaatttacattaaagggaaaagaccagtc

SEQ ID NO: 2283 - DNA, 3692 bp, Homo sapiens
cggatttaaagagacaggcgctccaaccgtcgtgggctgcccgcggcctgtaatgagcaagttccgaggcctacggtgagcgccggagccggagaggcagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgtacagccaatgaccttaaatgcatcatcaggttgatcaaacatgatctgaagatgaactcaggtgcaaaacatgtgttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtggcccactttaaggactacattccccaggcttttcctgggggccacagcatgatcttggattctgaagtgcttctgattgacaacaagacaggcaaaccactgccctttgggactctgggagtacacaagaaagcagccttccaggatgctaatgtctgcctgtttgtttttgattgtatctactttaatgatgtcagcttgatggacagacctctgtgtgagcggcggaagtttcttcatgacaacatggttgaaattccaaaccggatcatgttctcagaaatgaagcgagtcacaaaagctttggacttggctgacatgataacccgggtgatccaggagggattggaggggctggtgctgaaggatgtgaagggtacatatgagcctgggaagcggcactggctgaaagtgaagaaagactatttgaacgagggggccatggccgacacagctgacctggtggtccttggagccttctatgggcaagggagcaaaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggaccccagcaaaatacccagctggttgaaggtcaacaagatctactatcctgacttcatcgtcccagacccaaagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggcaacatgcagactgcaaagccttccgctatgaaggtgggggagaagctggccacaaagtcttctccagtgaaagtaggggagaagcggaaagctgctgatgagacgctgtgccaaacaaaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactactggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagttatctttgtcctttccccacctacacccccaataatttccctagagattaaggagtaaaggctgggctatggcagctctgtccacaaagccttctctcccatccttgcctgttcctttgtacttccaggctcattttaaagttgtatttaaaggactgccctcggaaatgcttctgtttagcggaacttgtattcagcctgacacgctttgccaggaacaaacctcatgtgaaagaaaacaaaatgaatttttttactttc

SEQ ID NO: 2284 - DNA, 3325 bp, Homo sapiens
ccacagcgctgtagactgcgccgcattagaagcctggcctcctgatgctgtgctcttcatctagacccaagccccaggtcgtgggacgatttctcccgtttttgactccctggaactgtattgcctgctttacctgcgtacatgttgattctttctcatggcaaccccgcaggaaaccatcaagatctcattttacagctgggattctctggttcacagaggtaacggagcttgcccgaggccagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaat

SEQ ID NO: 2285 - DNA, 4058 bp, Homo sapiens
gccagtgagcccccgcgacggtggcccggacggaaaagatacctcggcggcgtgggcccggctccctgctccaggacctagggatcttggccttccaccctcctccgagcaccaggactccctccagttccgtacccgaggcctccgtggtgaagaggtgccggacccgatgagctcgggagtccaccatcgctctgcaagccgcagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaatacatttagaaacttttaaagtcatgaaaaagcattaaccttctaaacagtatattctaaaaagtcaaaacgttaacaatagtttttatctaataaaagcactgcaagaaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactatt

SEQ ID NO: 2286 - DNA, 3953 bp, Homo sapiens
cggcatcttctggcgccagcttccggcttagcggctgagcttcaggcttgacgtcaggtgggaagggtgtggggtggcaggtgggggcggttgggaggctagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaatacatttagaaacttttaaagtcatgaaaaagcattaaccttctaaacagtatattctaaaaagtcaaaacgttaacaatagtttttatctaataaaagcactgcaagaaaatagggtagaattgttacagctggacttgtaaaaatatgtctttttactcagggtttaaaatgtcccatttaaatatgaaatgtaaacaaatttgttttttaaggttaaggccaaatgtaacaataaaaccctgtcgatggttttagctaaattagaggaagttgtatgagacttaatgatctaaaaacttaaaattgaattggtttgattaaaaataaagcttgcaattttaaaagtagctcacatttaatttcttgtgtgaaatagaacatgctttaaaggaagtatttttatgtgaatttgcattccagtataaatagtattcacaaaaaagattttcctagattttatctattgaataggtgtcaatatggcatgcatattgtaactttcattagaaataagttgctttgacttttaaaaatgacatagttagattatttaaagtcaatgtatatagtatatattatgtatggatttatataccaaattttggaatacagcctatctcatgaccatattgaaatgtacggaatttgatccatgcgatactatgtgtgcattatttgaaagttattggaaattttattcaaaccgtggaacaaatgtatgtgattttgttatacttcttaatttaaataaaatatttaatgcactatt

SEQ ID NO: 2287 - DNA, 3219 bp, Homo sapiens
cccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccaccca

SEQ ID NO: 2288 - DNA, 2587 bp, Homo sapiens
acaggccccgcctcggtccgcccctccgctcgctccccaagccgccgcggcgccgagccggtttccccgccggtgtccgagaggcgcccccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgtttt

SEQ ID NO: 2289 - DNA, 2032 bp, Homo sapiens
agacctccagagcccccagtgtagccacagaggatgctgttggcttcagccccaagaagacgccgcttcctccagagggctaagtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcc

SEQ ID NO: 2290 - DNA, 1279 bp, Homo sapiens
agcgggagacggccacgagattcccccatctctttgaatataattttagattgagattcagattaaatccgaggggaaaacactttatgaggctgaaagctgtgtcgttgccagagacagggttatgagctatcaaatgcaattacattaagacagattatactgggcaaattgagccatttagaaggtgagaatcaaagaaacggctctgatcctcttttcccccttctctctccctctccctctctctctaaattgcagttcgtagttccttccaattctgaggcacaaaagtaggtgagactgcttttgtatctgcgaagtgcttcactcctgaatgtaattctagctgagtgcaatctaggttaagagccggacaagcgggtaattagagcccgctagctgcccgaagaccggccgcccctccaaagcgcgccccgagtcggcgcccttctcccggccgagcctagctgcggctggacacggagcgcccgagatgatggtgctggacaaggaggacggcgtgccgatgctctccgtccagcccaaagggaagcagaagggctgtgcgggctgtaaccgcaagatcaaggaccgctatctgctgaaggcattggacaagtactggcacgaagactgcctcaagtgtgcctgctgtgactgccgcctgggcgaggtgggctccaccctctacaccaaggccaacctcatcctgtgccgacgcgactacctgaggctctttggcaccacagggaactgtgctgcttgcagcaagctgatcccagccttcgagatggtgatgcgggcccgggacaacgtgtatcacctcgactgcttcgcctgccagctctgcaaccagagattttgtgtgggagacaaattcttcctgaagaacaacatgatcttgtgtcagatggactatgaggaagggcagctcaatggcacctttgaatcccaagttcagtaacgcccggcgcctggcctccaggcccgtctgtccatctgcccgcctgcccacctgcctggccggccagccagccactctaccagtgcaggctggccagccgctctcctgccacattagaacttctccgtcctcgatgggagggatggcccttcctcctccaccaccgcccgtctgtgtgtgacccctcctggggccaggccgggcctgtacagtctgtcttctgtatataaatgggaacatttattttatgagaaatgtaatgcgattttattactggcgtggattaaacttatgaatgtttccgggaggtta

SEQ ID NO: 2291 - DNA, 1038 bp, Homo sapiens
gcccgggcagctgctgctcgcgaggctcccgcgatcccggcctggccgtctcgcccccgcgccttccccccagtccctcctcctgcgctccctgcccgcggggctgcgctccggactccggtccgtctgcccccgtcggcggtcgcggctctccggactcggcgcccgcgcggggccggcgggagcagcgcaggcggccggcggcgggagtcggagccacgcgcccctccgtatcctcggcgctagtccggctggagccgtcgggaccatggtgttggaccaggaggacggcgtgccgatgctctccgtccagcccaaagggaagcagaagggctgtgcgggctgtaaccgcaagatcaaggaccgctatctgctgaaggcattggacaagtactggcacgaagactgcctcaagtgtgcctgctgtgactgccgcctgggcgaggtgggctccaccctctacaccaaggccaacctcatcctgtgccgacgcgactacctgaggctctttggcaccacagggaactgtgctgcttgcagcaagctgatcccagccttcgagatggtgatgcgggcccgggacaacgtgtatcacctcgactgcttcgcctgccagctctgcaaccagagattttgtgtgggagacaaattcttcctgaagaacaacatgatcttgtgtcagatggactatgaggaagggcagctcaatggcacctttgaatcccaagttcagtaacgcccggcgcctggcctccaggcccgtctgtccatctgcccgcctgcccacctgcctggccggccagccagccactctaccagtgcaggctggccagccgctctcctgccacattagaacttctccgtcctcgatgggagggatggcccttcctcctccaccaccgcccgtctgtgtgtgacccctcctggggccaggccgggcctgtacagtctgtcttctgtatataaatgggaacatttattttatgagaaatgtaatgcgattttattactggcgtggattaaacttatgaatgtttc

SEQ ID NO: 2292 - DNA, 2294 bp, Homo sapiens
gaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctgtaacaactgctctgaaaagaagatatttttcaacctgaacttgcagtagctagtggagaggcaggaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccgggccgaaggtgcgaggggctccgggcggccgggcgggcgcacaccatccccgcgggcggcgcggagccggcgacagcgcgcgagagggaccgggcggtggcggcggcgggaccgggatggaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaacagctctgcaggcttaataaaaatgacagactgaaa

SEQ ID NO: 2293 - DNA, 1687 bp, Homo sapiens
ggctccgggcggccgggcgggcgcacaccatccccgcgggcggcgcggagccggcgacagcgcgcgagagggaccgggcggtggcggcggcgggaccgggatggaaggttaagtcctgagcagcagcagcagctgcagccgcctggagccaggctgcgcgccccggcccccgcctcggccgcggcgcgcccgcagcccggtgattcgctctctctctttggcgtttgaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagaggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgagtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaacagctctgcaggcttaataaaaatgacagactgaaa

SEQ ID NO: 2294 - DNA, 3567 bp, Homo sapiens
gctgggaccgagtcccggacgtcgcgacgcgcagggggctgctgcggccggcggtctcgggaaaagtgaggggacggaggcgcccaagcaacgtgggtttcgggaactgtgagtatttcactttgcgtagagccccctcgggcaatgcgacccagaaccgagggcttctttccccccgccggggcctccctcccgttctccactcggaacaaacagcctgcagttcccgcagctgcagcgcgggccgcggaacatgcgccgggagcggggcccgggcgggactccggagctggtactgctccccccgcgctccggcgccgggcctcgccgtgcggcctccttcctcccttcctcccgcccggctcggccggaggcggcggcggaggggcgaggcgcggccccccttcggcggcacctcctccccgggcaggcgcgggcggagccgggcccgcctcagccagccgcggcgggagcagcgcagcgcggcgccgcgggcagcgagctccgcattcgaacctccctcgcaaagacagtctccgccccacaatgcaccgcggcgggcagcctttgaaaaagcggcgcggctcgttcaagatggcggagctcgaccagttgcctgacgagagctcttcagcaaaagcccttgtcagtttaaaagaaggaagcttatctaacacgtggaatgaaaagtacagttctttacagaaaacacctgtttggaaaggcaggaatacaagctctgctgtggaaatgcctttcagaaattcaaaacgaagtcgacttttttctgatgaagatgataggcaaataaatacaaggtcacctaaaagaaaccagagggttgcaatggttccacagaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattaaaaaggaacatatcaagaaattaagggaaatgaacacagaagcagaaaaattgaaatcatattccatgcccatcagcattgaatttcagcggagatatgcaacaattgttctggagcttgaacagctgaacaaggacctaaacaaagttttgcataaagttcaacagtattgctatgagcttgctccagaccaggggctccagcctgcagatcagccaacagatatgagacgcaggtgtgaggaagaagcacaggaaattgttcggcatgcaaattcctcaacaggacagccctgcgttgaaaatgaaaatctgacagacttaatttccaggcttacagctattttgttacaaattaagtgtctagcagaaggaggagacctgaattcctttgaattcaaatcacttacagactcattaaatgatatcaagagtacaatagacgcttctaatatcagttgctttcagaataatgtagaaatccatgttgcacatattcagagtggcctgagccagatgggaaacttacatgcctttgcagcaaataacaccaacagagactgagtaaagatttcattattccaactgcacgggacattgtttttgagaagttcttttcctttatataggcttccaacaccaaataacctaactgctggaaaacaagggaaatttaaatctccaaataaggcattttaatagactgtactgcttcttaaaccagcattgctgaccagcattatatttatttttcttttattattcagatgcagtagcattgcttatgttacatatgtttatattcacaaatatttttaaactgaaatatctgaacataatataatttcgtggaagaatacattgaccattttttttaatgtgcatgaattcaccgcaacacatgcagacaactgctgcaatggagagtatgaagaaacctggtctttttattcatgtcggtggcagtgtggaaattccatccagaaaattacaactccacttgatttagttgatcaccatctcagtcttcaaaagataacatcatgaggtgtgggaagtcctagttttaaggaaaccactgaaatatagatgggaaatgtggactttacaagtatatgttatatatacttgcaatgtgacatggttctgtagatcattttataataataaatattttaatttatcataacatataaaagaaacctttgttgtttgttgaaagaaaatgaaggaacagggggaaaaaaggtgcaaaatgctaaatttctaaaaatggatttggcatgtcttcccatcagttcaggtcaaaagtgcattgttgtgagatttattaaaaaaaaaatgataacacactattttcatatttttttgtttatttgcacaacttttaaaccagattactggttaaaatccaacagtacacaatttataaagtaaaaagattttataaggaaaacaaatataataaccagtgctgtgaaatgcagaagaaaggcttgttttggttgtttttcttttttaggaaaacgctgcctaaaatgttaatcttgtaaaaagtatgtatttggaattttcttcgttttaatagaatattataaactcaaaatataaatttttttcaaatttggagtttaagatatagctgtagaggtggttttaattcctttagatgtctcataaaatgagactttttatatgttaatgtataataaaactgaaacaagattattttccatttgaaatttttgtatagtttaaaaaggcttccgtattctttgttggtattgtgccactgcagaactttagtgcagagtttatatttagctaaactgttatgttaattaagaaatgcataaatcttctattcttaatatttgtaattctaaataaattgatctatgaaaatta

SEQ ID NO: 2295 - DNA, 3219 bp, Homo sapiens
agcgcgggccgcggaacatgcgccgggagcggggcccgggcgggactccggagctggtactgctccccccgcgctccggcgccgggcctcgccgtgcggcctccttcctcccttcctcccgcccggctcggccggaggcggcggcggaggggcgaggcgcggccccccttcggcggcacctcctccccgggcaggcgcgggcggagccgggcccgcctcagccagccgcggcgggagcagcgcagcgcggcgccgcgggcagcgagctccgcattcgaacctccctcgcaaagacagtctccgccccacaatgcaccgcggcgggcagcctttgaaaaagcggcgcggctcgttcaagatggcggagctcgaccagttgcctgacgagagctcttcagcaaaagcccttgtcagtttaaaagaaggaagcttatctaacacgtggaatgaaaagtacagttctttacagaaaacacctgtttggaaaggcaggaatacaagctctgctgtggaaatgaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattaaaaaggaacatatcaagaaattaagggaaatgaacacagaagcagaaaaattgaaatcatattccatgcccatcagcattgaatttcagcggagatatgcaacaattgttctggagcttgaacagctgaacaaggacctaaacaaagttttgcataaagttcaacagtattgctatgagcttgctccagaccaggggctccagcctgcagatcagccaacagatatgagacgcaggtgtgaggaagaagcacaggaaattgttcggcatgcaaattcctcaacaggacagccctgcgttgaaaatgaaaatctgacagacttaatttccaggcttacagctattttgttacaaattaagtgtctagcagaaggaggagacctgaattcctttgaattcaaatcacttacagactcattaaatgatatcaagagtacaatagacgcttctaatatcagttgctttcagaataatgtagaaatccatgttgcacatattcagagtggcctgagccagatgggaaacttacatgcctttgcagcaaataacaccaacagagactgagtaaagatttcattattccaactgcacgggacattgtttttgagaagttcttttcctttatataggcttccaacaccaaataacctaactgctggaaaacaagggaaatttaaatctccaaataaggcattttaatagactgtactgcttcttaaaccagcattgctgaccagcattatatttatttttcttttattattcagatgcagtagcattgcttatgttacatatgtttatattcacaaatatttttaaactgaaatatctgaacataatataatttcgtggaagaatacattgaccattttttttaatgtgcatgaattcaccgcaacacatgcagacaactgctgcaatggagagtatgaagaaacctggtctttttattcatgtcggtggcagtgtggaaattccatccagaaaattacaactccacttgatttagttgatcaccatctcagtcttcaaaagataacatcatgaggtgtgggaagtcctagttttaaggaaaccactgaaatatagatgggaaatgtggactttacaagtatatgttatatatacttgcaatgtgacatggttctgtagatcattttataataataaatattttaatttatcataacatataaaagaaacctttgttgtttgttgaaagaaaatgaaggaacagggggaaaaaaggtgcaaaatgctaaatttctaaaaatggatttggcatgtcttcccatcagttcaggtcaaaagtgcattgttgtgagatttattaaaaaaaaaatgataacacactattttcatatttttttgtttatttgcacaacttttaaaccagattactggttaaaatccaacagtacacaatttataaagtaaaaagattttataaggaaaacaaatataataaccagtgctgtgaaatgcagaagaaaggcttgttttggttgtttttcttttttaggaaaacgctgcctaaaatgttaatcttgtaaaaagtatgtatttggaattttcttcgttttaatagaatattataaactcaaaatataaatttttttcaaatttggagtttaagatatagctgtagaggtggttttaattcctttagatgtctcataaaatgagactttttatatgttaatgtataataaaactgaaacaagattattttccatttgaaatttttgtatagtttaaaaaggcttccgtattctttgttggtattgtgccactgcagaactttagtgcagagtttatatttagctaaactgttatgttaattaagaaatgcataaatcttctattcttaatatttgtaattctaaataaattgatctatg

SEQ ID NO: 2296 - DNA, 1569 bp, Homo sapiens
atgcgacccagaaccgagggcttctttccccccgccggggcctccctcccgttctccactcggaacaaacagcctgcagttcccgcagctgcagcgcgggccgcggaacatgcgccgggagcggggcccgggcgggactccggagctggtactgctccccccgcgctccggcgccgggcctcgccgtgcggcctccttcctcccttcctcccgcccggctcggccggaggcggcggcggaggggcgaggcgcggccccccttcggcggcacctcctccccgggcaggcgcgggcggagccgggcccgcctcagccagccgcggcgggagcagcgcagcgcggcgccgcgggcagcgagctccgcattcgaacctccctcgcaaagacagtctccgccccacaatgcaccgcggcgggcagcctttgaaaaagcggcgcggctcgttcaagatggcggagctcgaccagttgcctgacgagagctcttcagcaaaagcccttgtcagtttaaaagaaggaagcttatctaacacgtggaatgaaaagtacagttctttacagaaaacacctgtttggaaaggcaggaatacaagctctgctgtggaaatgcctttcagaaattcaaaacgaagtcgacttttttctgatgaagatgataggcaaataaatacaaggtcacctaaaagaaaccagagggttgcaatggttccacagaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattaaaggaacatatcaagaaattaagggaaatgaacacagaagcagaaaaattggt

SEQ ID NO: 2297 - DNA, 3186 bp, Homo sapiens
gaaacagctgagcagaacagttctttagctgtcggcctaaatgaccaacttcatgacctctcaaggtctcgctccccggctgcacgcagctcagcttccaacattcgggaaaggcgtgcccggatcgcgaggggccgctgggaccgagtcccggacgtcgcgacgcgcagggggctgctgcggccggcggtctcgggaaaagtgaggggacggaggcgcccaagcaacgtgggtttcgggaactgctcttcagcaaaagcccttgtcagtttaaaagaaggaagcttatctaacacgtggaatgaaaagtacagttctttacagaaaacacctgtttggaaaggcaggaatacaagctctgctgtggaaatgcctttcagaaattcaaaacgaagtcgacttttttctgatgaagatgataggcaaataaatacaaggtcacctaaaagaaaccagagggttgcaatggttccacagaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattaaaaaggaacatatcaagaaattaagggaaatgaacacagaagcagaaaaattgaaatcatattccatgcccatcagcattgaatttcagcggagatatgcaacaattgttctggagcttgaacagctgaacaaggacctaaacaaagttttgcataaagttcaacagtattgctatgagcttgctccagaccaggggctccagcctgcagatcagccaacagatatgagacgcaggtgtgaggaagaagcacaggaaattgttcggcatgcaaattcctcaacaggacagccctgcgttgaaaatgaaaatctgacagacttaatttccaggcttacagctattttgttacaaattaagtgtctagcagaaggaggagacctgaattcctttgaattcaaatcacttacagactcattaaatgatatcaagagtacaatagacgcttctaatatcagttgctttcagaataatgtagaaatccatgttgcacatattcagagtggcctgagccagatgggaaacttacatgcctttgcagcaaataacaccaacagagactgagtaaagatttcattattccaactgcacgggacattgtttttgagaagttcttttcctttatataggcttccaacaccaaataacctaactgctggaaaacaagggaaatttaaatctccaaataaggcattttaatagactgtactgcttcttaaaccagcattgctgaccagcattatatttatttttcttttattattcagatgcagtagcattgcttatgttacatatgtttatattcacaaatatttttaaactgaaatatctgaacataatataatttcgtggaagaatacattgaccattttttttaatgtgcatgaattcaccgcaacacatgcagacaactgctgcaatggagagtatgaagaaacctggtctttttattcatgtcggtggcagtgtggaaattccatccagaaaattacaactccacttgatttagttgatcaccatctcagtcttcaaaagataacatcatgaggtgtgggaagtcctagttttaaggaaaccactgaaatatagatgggaaatgtggactttacaagtatatgttatatatacttgcaatgtgacatggttctgtagatcattttataataataaatattttaatttatcataacatataaaagaaacctttgttgtttgttgaaagaaaatgaaggaacagggggaaaaaaggtgcaaaatgctaaatttctaaaaatggatttggcatgtcttcccatcagttcaggtcaaaagtgcattgttgtgagatttattaaaaaaaaaatgataacacactattttcatatttttttgtttatttgcacaacttttaaaccagattactggttaaaatccaacagtacacaatttataaagtaaaaagattttataaggaaaacaaatataataaccagtgctgtgaaatgcagaagaaaggcttgttttggttgtttttcttttttaggaaaacgctgcctaaaatgttaatcttgtaaaaagtatgtatttggaattttcttcgttttaatagaatattataaactcaaaatataaatttttttcaaatttggagtttaagatatagctgtagaggtggttttaattcctttagatgtctcataaaatgagactttttatatgttaatgtataataaaactgaaacaagattattttccatttgaaatttttgtatagtttaaaaaggcttccgtattctttgttggtattgtgccactgcagaactttagtgcagagtttatatttagctaaactgttatgttaattaagaaatgcataaatcttctattcttaatatttgtaattctaaataaattgatctatgaaaatta

SEQ ID NO: 2298 - DNA, 16535 bp, Homo sapiens
aaagacagaaccccagagaaaaacgctgccaattcgttgctttattgttccctgcctggggacctcaatagccttttccattaaccttcccttcttacgcaacggttaatgactttgggggttgttttgctttctgtttctgctgagtcactaaattttgcctctttgtccccaggtgctgctcagcataaaagttaaaagtgcaattcaggaagtactgggattctgtgtagagccgaggaaaccatttccctaagagaagctctgttccttggcttgtccttccttcccgggaaggaagcttccgaggaacgaagggagaagctttgttttgcctgcagaagcagccctgtgctcggctgagggttctcagctggctgtgaactgcggagcattgtaggcgcctggctggctcaggccaatgcagaagtctctcccttctccaaagacccaaatccccacagaaccagcttcgagttactttcccttcaaggggattaaaataattgtgatttgtggcgctctccgttcgcggtggtattttcctgttgtgttaaatgcctcttattaagtaatagatgtgatttatgtgaacgacgaaggggtgtgtggtggattcggtgattaatcagtgaattcccatccgctggcatctctcactgcccctcttgcgtgatgtaagatcagacgtaccctgcattgaaaagtcaagacacacgggcgtctcgctcgcgctcacacacgctctgcctcctctctcccgcacgcgcgcatccctccaccttccacatcctgctccaggcaggagaaggctgactggctggactcattgagctgaagaatttccagtgacatttgtaaatgacgccgctcgattccaggctccaagcggcccctgccgccgccgccgccgccgggccgaaggtgccgccgagcagtctccagcgcaggcttccttaccgggcgaccacaatgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctgtcccgaggaggtagaaatcaagtgccccttgaatcacattgcttgccttggtaccaacaaatgtgttcatttatcccagctgtgcaatggtgtcttggactgcccagatgggtatgacgaaggagtacattgtcaggaactgttatccaattgccaacagctgaattgtcagtataaatgtacaatggtcagaaatagtacaagatgttactgtgaggatggattcgaaataacagaagatgggagaagctgtaaagatcaagatgaatgtgctgtttatggtacatgcagccagacctgcagaaacacacatggatcctacacttgcagttgtgtggaaggctacctaatgcagccagacaacagatcttgcaaggctaaaattgaacctacagatagaccacctatactattaattgcaaattttgaaacaattgaggttttctatcttaatggaagtaaaatggcaactctaagctcagtcaatggaaatgaaattcatactctggattttatttataatgaagatatgatttgttggattgaatcaagagaatcttcaaatcaactcaaatgtatccagataacaaaagcaggaggattaacagatgaatggacaatcaatattcttcaatccttccacaatgtgcaacaaatggcgattgactggctcactcgaaatctctattttgtggaccatgtcggtgaccggatctttgtttgtaattccaacggttctgtatgtgtcaccctgattgatctggagcttcacaatcctaaagcaatagcagtagatccaatagcaggaaaacttttctttactgactacgggaatgtcgccaaagtggagagatgtgacatggatgggatgaaccgaacaaggataattgattcaaagacagagcagccagctgcactggcactagacctagtcaacaaattggtttactgggtagatctttacttggactatgtgggagtagtggactatcaaggaaaaaatagacacactgtcattcaaggcagacaagttagacatctttatggtataactgtgtttgaagattatttgtatgcaaccaattctgataactacaatatcgtaaggataaaccgatttaatgggactgatattcactcattaattaaaattgagaatgcttggggaatccgaatttatcaaaaaagaactcaaccaacagtcagaagccatgcatgtgaagtcgatccatatggaatgccagggggctgttcacacatctgtctactcagcagcagttacaaaactcggacttgtcgctgcaggactggcttcaacttgggaagtgatggcaggtcatgcaaaagaccaaagaatgagttgttcctcttttatgggaaaggacgcccaggaattgttagaggaatggacttgaataccaagatagctgatgaatacatgatccccatagaaaatctggtaaaccctcgtgctttagactttcacgcagaaaccaattacatctactttgctgacaccaccagtttcctaattggccggcagaagatagatggcacagagagagaaaccatcctgaaagatgatctggataatgtagagggcattgctgtggactggattggaaataatctttactggaccaatgatggccataggaaaaccattaatgtggccaggctggaaaaagcttctcagagtcggaagactcttttagagggtgaaatgtctcatcccagaggaattgtggtggatccagttaatggttggatgtattggacagactgggaggaagatgaaatagatgacagcgtgggaaggattgagaaggcctggatggatggattcaatcggcagatttttgtgacttcaaagatgctgtggccaaacggtttaactctggactttcacaccaacacattatactggtgtgatgcctattacgatcatattgaaaaagtatttttgaatgggactcacaggaagattgtttacagtgggagagagttgaaccaccctttcggactgtcgcatcatggaaattatgtgttctggactgattatatgaatggttccatttttcaactagatttgataacaagtgaggtgacattgctgaggcatgaaagaccacccctatttgggcttcagatttatgatccacgaaagcaacaaggtgacaatatgtgccgagtaaataatgggggctgtagtacactttgcttggctatcccaggaggccgggtgtgtgcttgtgccgataatcaacttttggatgaaaatgggacaacttgcacatttaatcctggagaagcactacctcacatatgtaaagctggagagtttcgctgcaaaaacagacactgtatccaagctcggtggaaatgtgatggcgacgatgactgcctagacggaagcgatgaggattcagtaaactgcttcaatcatagctgtcctgatgatcagtttaaatgccagaataatcgctgcatccccaagagatggctttgtgatggagctaatgactgtgggagcaatgaagatgaatccaatcaaacttgcacagccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacggaactgggttagaaactgttatttcaagagatattcagagtatcagagggctagcagtggattgggtgtcacgtaatttatactggattagctcagaatttgatgaaacgcaaattaatgtggcaaggctagatggctctttgaaaacctcaattatccatggaatcgataagccacagtgtcttgcagctcacccagtcaggggaaaactctactggaccgatggaaacacaattaacatggcaaatatggatggcagtaatagcaagattctgtttcagaatcagaaggagccagttggtctatcgatagactatgtggaaaacaagctttattggatcagttcagggaatggaaccataaatagatgcaacctggatggtggtaatttagaagtaatcgagtcaatgaaagaagaattaacaaaagctacagccctaaccatcatggataagaaactgtggtgggcagaccaaaacttagcccagctaggaacctgcagcaaaagagacggaagaaaccccaccatcctacggaataagacttctggggtagttcatatgaaagtctatgataaagaagcacagcaaggcagcaattcctgccaactaaacaatggtggatgctctcaactttgtttaccaacatctgaaactacaaggacttgtatgtgtacagtgggatattatctccaaaagaaccgtatgtcatgtcaaggtatagaatcatttcttatgtactctgttcatgaaggaatcaggggaatacctcttgaaccaagtgacaaaatggatgctttgatgcctatatcaggaacttcatttgccgtgggaatagatttccatgcagaaaatgataccatctactggacagacatgggcttcaataaaattagcagagctaaaagagatcagacttggaaagaagatatcattaccaatggcttgggaagagtggaagggatagctgttgactggattgctggtaacatatattggacagatcatggtttcaacttaattgaagttgcaagactcaatggttctttccgttatgtaattatttcccaaggcctggatcaaccaagatctatagctgtgcacccagagaaaggcctcttgttctggactgaatggggacaaatgccctgtattggaaaggctcgcttggatggctcagagaaggttgtccttgtaagcatgggaatagcatggccgaatggcatctccatcgactatgaggaaaataaattgtactggtgtgatgctcgcacagacaagatagagagaatcgaccttgagactggagggaatcgcgagatggtgctgtcaggaagcaatgtggatatgttttcagttgcagtctttggggcttacatctactggtctgacagagcacatgcaaacgggtctgtcagaaggggccacaagaatgatgccacagaaacgataaccatgagaaccggccttggagtcaacctgaaggaggttaaaatatttaaccgagtaagagagaaagggaccaatgtttgtgccagggacaatggtggctgtaagcaactctgtctttatcgaggaaattcccggagaacttgtgcttgtgcccatggatatttggcagaagatggagttacttgcctgaggcatgaaggctatttactgtattcaggaagaacaatattaaaaagtatacatctttctgatgaaaccaatttaaattccccaataaggccatatgagaatccacgttatttcaagaatgtcatagccttggcttttgactataatcaaagaagaaaaggtaccaaccgaatcttttacagtgatgcacactttggaaatatacagcttattaaagacaactgggaagacagacaagtaattgttgaaaatgtgggttctgtggaaggacttgcctatcacagagcctgggatacactgtactggacaagctctaccacctcatccatcaccagacacactgtggaccagactcggcctggagcatttgacagggaagctgtcatcaccatgtcagaagatgaccatccacatgtgctagccttggatgaatgtcaaaatttaatgttttggaccaactggaatgaacaacatccaagtatcatgagatctactctgactgggaaaaatgctcaagtggtggtcagtacagacatactcactccaaatggacttactatcgactaccgtgcagagaagctgtatttctcagatggcagtctaggaaaaattgaaaggtgtgaatacgatggatcccagagacatgtgatagttaaatctgggccagggactttcctcagtttggctgtttatgacaattatatattctggtcggactggggaagaagagctatactgcggtccaacaagtacacaggaggagatacaaaaattcttcgttccgatattccacatcagccaatgggaatcatagctgttgccaatgacaccaatagctgtgaactttctccatgtgcattattgaatggaggctgccatgacttgtgccttttaactcccaatgggagagtgaattgttcctgcagaggggaccgaatattgctagaggacaacagatgtgtgactaaaaattcctcctgcaacgcttattcggagtttgaatgtggaaatggtgagtgcattgactaccagctcacctgtgatggcattcctcactgtaaagataaatcagatgaaaaactgctctactgtgaaaacagaagctgtcgaagaggcttcaagccatgctataatcgccgctgcattcctcatggcaagttatgtgatggagaaaatgactgcggagacaactctgatgaattagattgtaaagtttcaacctgtgccacggttgagttccgctgtgcagatgggacttgtattccaagatcagcacgatgcaaccagaacatagattgtgcagatgcttcagatgaaaagaactgcaataacacagactgcacacatttctataagcttggagtgaaaaccacagggttcataagatgtaattctacctcactgtgtgttctgccaacctggatatgcgacgggtctaatgactgtggagactattcagatgaattaaagtgcccagttcaaaacaaacacaaatgtgaagaaaattattttagttgtcctagtggaagatgcattttgaatacctggatatgcgatggtcagaaagattgtgaggatggacgtgatgaattccactgtgattcttcttgctcttggaaccaatttgcttgttccgcacaaaaatgtatttctaagcattggatttgtgatggagaagatgactgtggggatgggttagatgaaagtgacagcatttgtggtgccataacctgtgctgctgacatgttcagctgccagggctctcgtgcctgcgtgccccgacattggctttgtgatggtgaaagggactgtccagatggaagcgatgagctttccacagcaggctgcgctcccaataatacatgtgatgaaaatgctttcatgtgccataataaagtatgcattcccaagcaatttgtttgtgaccatgatgacgactgtggagatggctctgatgagtcaccgcagtgtggatatcgacagtgtggtacagaagaatttagttgtgctgatgggcggtgtcttctaaatactcaatggcagtgtgatggagactttgactgtcctgaccattctgatgaagcacctttaaacccaaagtgtaaaagtgcagaacagtcatgcaacagttcattttttatgtgcaaaaatggcaggtgcattcccagtggaggtctttgcgacaataaggatgactgtggcgatggttcagatgagagaaactgccatataaatgaatgtttgagtaagaaagtcagtggatgttctcaagactgtcaagaccttccggtcagttataagtgcaaatgctggcctggattccaactgaaggatgacggcaaaacatgtgtagacattgatgaatgctcttcaggctttccctgtagccagcaatgcatcaatacatacgggacttacaagtgcctctgtacagatgggtatgaaatacaacctgataacccaaatggctgcaaatcgctctcagatgaagaaccttttttaattcttgctgatcatcatgagataaggaaaattagcactgatggctccaactacacacttttaaaacagggattaaacaatgttattgctatagactttgattacagagaagaattcatctattggatcgattctagccgacccaatggcagtcgcataaatagaatgtgtttaaatggaagtgacattaaggtagttcataacacagcggtccccaatgcacttgctgtcgattggattggaaaaaacctctattggtctgacacagaaaaaagaatcattgaagtatccaaactcaatggcttgtaccctactatactcgttagcaaaaggctgaagtttcccagagacttgtctttagatcctcaagctggatatttgtattggattgactgctgcgagtatcctcatattggccgtgttggaatggatggaaccaatcagagtgttgtcatagaaaccaagatttctagacctatggcactaacaatagattatgttaatcgtagactctactgggccgatgaaaatcacattgaatttagcaacatggatggatctcatagacacaaagtccctaatcaagatattccaggggtgattgcactaacattgtttgaagactacatctactggactgatgggaaaaccaagtcactcagccgtgcccataaaacatcgggagcagacagactctcactgatttactcatggcatgccatcacagatatccaggtgtatcattcttatagacaacctgatgtctccaaacatctctgcatgataaataatggtggttgcagtcatttgtgccttttagcccctggaaaaacccacacttgtgcatgtcccactaacttctatctggcagctgataataggacttgcttatccaactgcacagccagccagtttcgttgcaaaactgacaaatgtattccattctggtggaaatgtgacaccgtggatgactgtggtgatggatctgatgaacctgatgactgtcctgaatttagatgtcagccaggccgatttcagtgtgggactggactctgtgctctaccagctttcatctgtgatggagagaatgattgtggagacaattctgatgaactcaactgtgacacacatgtctgcctgtcaggtcaattcaaatgtaccaagaaccagaaatgtatcccagtaaacttaagatgtaatgggcaagatgactgtggtgatgaggaagatgaaagagactgtcctgaaaacagctgttctccagactatttccagtgtaagactacgaagcattgcatttccaagctgtgggtttgtgacgaggatccagactgtgcagatgcatcagacgaggccaactgcgataaaaagacttgtggacctcatgaattccagtgtaaaaacaacaactgtattcccgatcactggcggtgtgatagccaaaatgactgcagtgataattcagatgaagaaaactgtaagccacagacatgtacattgaaagatttcctctgtgccaatggggactgtgtttcttcaaggttttggtgtgatggagattttgactgtgcagatggctctgatgagagaaattgtgagacaagttgttccaaagatcagttccggtgttccaatggtcagtgtataccagcaaaatggaaatgtgatggccatgaagactgcaaatatggggaagatgagaaaagctgtgagccagcttctcctacttgctcatcacgtgaatatatatgtgccagtgatggatgtatttcagcatctttgaaatgtaatggagaatatgattgtgctgatggttcagatgagatggactgtgtgactgaatgtaaggaagatcagtttcggtgcaaaaataaagcccactgtattccaattagatggctgtgtgatggaattcatgactgtgtggatggcagtgatgaagagaactgtgaaagaggaggaaatatatgtagagctgatgagttcctttgcaataattctctctgcaaactacatttctgggtgtgtgatggagaggacgactgtggagacaactctgatgaagcccctgatatgtgtgtcaaatttctttgtccatccacgagacctcacagatgcagaaataacagaatatgcctacagtcggagcaaatgtgcaatgggattgatgaatgcggtgacaattcagatgaagatcactgtggtggtaagctgacatataaagcaaggccttgtaaaaaggatgagtttgcttgtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaagagatatgattatttggagtactcagtttaatccaggcggaattttctacaaaaggatccatggcagagaaaaaaggcaagcaaacagtggcttgatttgtcctgaatttaaaaggcccagggacattgcagttgactgggtggctggaaacatttactggactgatcattctagaatgcattggttcagttactacactactcactggaccagtctgaggtactctatcaacgtagggcagctgaatggccccaactgcaccagactcttaacaaatatggctggagaaccctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtcttttagatcctggctttatgatagacccaacaaaggccaggtacatagggggaggacccagtgctttcaagcttccacacacagcgccgcccatctacctaaactctgatttgaaaggaccactaactgctgggccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcttttatatgctgtataaatgtataaaatataaggattacttttgtatgttccaacagtattatacttgttttggcatcagcattacctctttctttatctttttcctggttaattgttttctgagttttttgggttttattttttgctgatgactattgattgaccatttgtatggtatttttatgaaaaagaactgcactacagtacaatttacaacaatgctgctgatatgacacacctttgaatttgttaaaattaaaaacaacgtattcctttgtagtgtgaatatgagcaatctattttatatgaacttttttggttgtacttaatcaacgaggagaatctctgcacttttccattatacggtttgaaggctgtaatacagtgtcatattatttttctgtttaaattgatggaaaaatgattgaatggtcaactctcttctttgtgcccataaagatcgattcagactctgctgaaaatatatagctctcacaagttcagcatcacctgctttgaaattagccttagattgccaaccaatagatgagaattttgaggaaaaaaattaaaaatatgtaaaattaataatttgcatgaacacagatgactacattttccaaaacttagtggactctatgtgatgtactaaatgtatacaccttgtaagcaatagttatatttaggtggtagaacatagcaaaaatataaccgaaagttggccgactgcacttgctatggaataagaccttttattctccctcagtctcgagataaatagccagcctagagcacaacagggcattgggtacttgcatcttaggtatttcttcccagtcacatccattttgtggaagattaacccaaccccttacactacactgaacactaaagaataatatataagcacacaaattggtgacagaatttcaattacgtgaacgcatcctctttgctaggtcaaaaaacaaagggcaaagcagacattttagtatacagagtgattggcaaatattttcaagatttaatatgagcaacccattatttgccctatccaaaatatattcaagggccttccaagttgtagaagaacaatgatcttcccataatcaaaagtggagagtcgaaatgctgtgccagttgctctggtattcaggtttctctgggttttacagaacgcatggaccccattcacgtttggtttgtttatcttcaaatttgagttgaaacgagtgcgatttatttaagttgtatataaaaataaaaggatagcatttttatacaaatatctttaaaggcacaaaagatttattcacaagttttggagggctttttgttcctctgatagacatgactgacttttagctgtcataatgtattaacctaacagatgaaatatgttaaatatgtggttgctctttatccctttgtacaagcattaaaaaaactgctgttttataagaagactttttgttgtactatgtgcatgcatactacctatttctaaactttgccatattgaggcctttataaactattgatttatgtaatactagtgcaattttgcttgaacaatgttatgcatatcataaactttttcaggttcttgtttaagtacattttttaaattgaacagtatttttcattttggttataatatagtcattttgcctatgtttctacaatgaagtgttaaatactttataaaaaattgttgactgacttatttaaatgaaattctacatatttaa

SEQ ID NO: 2299 - DNA, 2621 bp, Homo sapiens
gcattgaaaagtcaagacacacgggcgtctcgctcgcgctcacacacgctctgcctcctctctcccgcacgcgcgcatccctccaccttccacatcctgctccaggcaggagaaggctgactggctggactcattgagctgaagaatttccagtgacatttgtaaatgacgccgctcgattccaggctccaagcggcccctgccgccgccgccgccgccgggccgaaggtgccgccgagcagtctccagcgcaggcttccttaccgggcgaccacaatgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacgg

SEQ ID NO: 2300 - DNA, 15371 bp, Homo sapiens
tttttacattcaggtcccgaggaggtagaaatcaagtgccccttgaatcacattgcttgccttggtaccaacaaatgtgttcatttatcccagctgtgcaatggtgtcttggactgcccagatgggtatgacgaaggagtacattgtcagggtgagtccatttgtcaacaactgaattgtacaatgtacaagtacaaatgtacaatggtcagaaatagtacaagatgttactgtgaggatggattcgaaataacagaagatgggagaagctgtaaagatcaagatgaatgtgctgtttatggtacatgcagccagacctgcagaaacacacatggatcctacacttgcagttgtgtggaaggctacctaatgcagccagacaacagatcttgcaaggctaaaattgaacctacagatagaccacctatactattaattgcaaattttgaaacaattgaggttttctatcttaatggaagtaaaatggcaactctaagctcagtcaatggaaatgaaattcatactctggattttatttataatgaagatatgatttgttggattgaatcaagagaatcttcaaatcaactcaaatgtatccagataacaaaagcaggaggattaacagatgaatggacaatcaatattcttcaatccttccacaatgtgcaacaaatggcgattgactggctcactcgaaatctctattttgtggaccatgtcggtgaccggatctttgtttgtaattccaacggttctgtatgtgtcaccctgattgatctggagcttcacaatcctaaagcaatagcagtagatccaatagcaggaaaacttttctttactgactacgggaatgtcgccaaagtggagagatgtgacatggatgggatgaaccgaacaaggataattgattcaaagacagagcagccagctgcactggcactagacctagtcaacaaattggtttactgggtagatctttacttggactatgtgggagtagtggactatcaaggaaaaaatagacacactgtcattcaaggcagacaagttagacatctttatggtataactgtgtttgaagattatttgtatgcaaccaattctgataactacaatatcgtaaggataaaccgatttaatgggactgatattcactcattaattaaaattgagaatgcttggggaatccgaatttatcaaaaaagaactcaaccaacagtcagaagccatgcatgtgaagtcgatccatatggaatgccagggggctgttcacacatctgtctactcagcagcagttacaaaactcggacttgtcgctgcaggactggcttcaacttgggaagtgatggcaggtcatgcaaaagaccaaagaatgagttgttcctcttttatgggaaaggacgcccaggaattgttagaggaatggacttgaataccaagatagctgatgaatacatgatccccatagaaaatctggtaaaccctcgtgctttagactttcacgcagaaaccaattacatctactttgctgacaccaccagtttcctaattggccggcagaagatagatggcacagagagagaaaccatcctgaaagatgatctggataatgtagagggcattgctgtggactggattggaaataatctttactggaccaatgatggccataggaaaaccattaatgtggccaggctggaaaaagcttctcagagtcggaagactcttttagagggtgaaatgtctcatcccagaggaattgtggtggatccagttaatggttggatgtattggacagactgggaggaagatgaaatagatgacagcgtgggaaggattgagaaggcctggatggatggattcaatcggcagatttttgtgacttcaaagatgctgtggccaaacggtttaactctggactttcacaccaacacattatactggtgtgatgcctattacgatcatattgaaaaagtatttttgaatgggactcacaggaagattgtttacagtgggagagagttgaaccaccctttcggactgtcgcatcatggaaattatgtgttctggactgattatatgaatggttccatttttcaactagatttgataacaagtgaggtgacattgctgaggcatgaaagaccacccctatttgggcttcagatttatgatccacgaaagcaacaaggtgacaatatgtgccgagtaaataatgggggctgtagtacactttgcttggctatcccaggaggccgggtgtgtgcttgtgccgataatcaacttttggatgaaaatgggacaacttgcacatttaatcctggagaagcactacctcacatatgtaaagctggagagtttcgctgcaaaaacagacactgtatccaagctcggtggaaatgtgatggcgacgatgactgcctagacggaagcgatgaggattcagtaaactgcttcaatcatagctgtcctgatgatcagtttaaatgccagaataatcgctgcatccccaagagatggctttgtgatggagctaatgactgtgggagcaatgaagatgaatccaatcaaacttgcacagccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacggaactgggttagaaactgttatttcaagagatattcagagtatcagagggctagcagtggattgggtgtcacgtaatttatactggattagctcagaatttgatgaaacgcaaattaatgtggcaaggctagatggctctttgaaaacctcaattatccatggaatcgataagccacagtgtcttgcagctcacccagtcaggggaaaactctactggaccgatggaaacacaattaacatggcaaatatggatggcagtaatagcaagattctgtttcagaatcagaaggagccagttggtctatcgatagactatgtggaaaacaagctttattggatcagttcagggaatggaaccataaatagatgcaacctggatggtggtaatttagaagtaatcgagtcaatgaaagaagaattaacaaaagctacagccctaaccatcatggataagaaactgtggtgggcagaccaaaacttagcccagctaggaacctgcagcaaaagagacggaagaaaccccaccatcctacggaataagacttctggggtagttcatatgaaagtctatgataaagaagcacagcaaggcagcaattcctgccaactaaacaatggtggatgctctcaactttgtttaccaacatctgaaactacaaggacttgtatgtgtacagtgggatattatctccaaaagaaccgtatgtcatgtcaaggtatagaatcatttcttatgtactctgttcatgaaggaatcaggggaatacctcttgaaccaagtgacaaaatggatgctttgatgcctatatcaggaacttcatttgccgtgggaatagatttccatgcagaaaatgataccatctactggacagacatgggcttcaataaaattagcagagctaaaagagatcagacttggaaagaagatatcattaccaatggcttgggaagagtggaagggatagctgttgactggattgctggtaacatatattggacagatcatggtttcaacttaattgaagttgcaagactcaatggttctttccgttatgtaattatttcccaaggcctggatcaaccaagatctatagctgtgcacccagagaaaggcctcttgttctggactgaatggggacaaatgccctgtattggaaaggctcgcttggatggctcagagaaggttgtccttgtaagcatgggaatagcatggccgaatggcatctccatcgactatgaggaaaataaattgtactggtgtgatgctcgcacagacaagatagagagaatcgaccttgagactggagggaatcgcgagatggtgctgtcaggaagcaatgtggatatgttttcagttgcagtctttggggcttacatctactggtctgacagagcacatgcaaacgggtctgtcagaaggggccacaagaatgatgccacagaaacgataaccatgagaaccggccttggagtcaacctgaaggaggttaaaatatttaaccgagtaagagagaaagggaccaatgtttgtgccagggacaatggtggctgtaagcaactctgtctttatcgaggaaattcccggagaacttgtgcttgtgcccatggatatttggcagaagatggagttacttgcctgaggcatgaaggctatttactgtattcaggaagaacaatattaaaaagtatacatctttctgatgaaaccaatttaaattccccaataaggccatatgagaatccacgttatttcaagaatgtcatagccttggcttttgactataatcaaagaagaaaaggtaccaaccgaatcttttacagtgatgcacactttggaaatatacagcttattaaagacaactgggaagacagacaagtaattgttgaaaatgtgggttctgtggaaggacttgcctatcacagagcctgggatacactgtactggacaagctctaccacctcatccatcaccagacacactgtggaccagactcggcctggagcatttgacagggaagctgtcatcaccatgtcagaagatgaccatccacatgtgctagccttggatgaatgtcaaaatttaatgttttggaccaactggaatgaacaacatccaagtatcatgagatctactctgactgggaaaaatgctcaagtggtggtcagtacagacatactcactccaaatggacttactatcgactaccgtgcagagaagctgtatttctcagatggcagtctaggaaaaattgaaaggtgtgaatacgatggatcccagagacatgtgatagttaaatctgggccagggactttcctcagtttggctgtttatgacaattatatattctggtcggactggggaagaagagctatactgcggtccaacaagtacacaggaggagatacaaaaattcttcgttccgatattccacatcagccaatgggaatcatagctgttgccaatgacaccaatagctgtgaactttctccatgtgcattattgaatggaggctgccatgacttgtgccttttaactcccaatgggagagtgaattgttcctgcagaggggaccgaatattgctagaggacaacagatgtgtgactaaaaattcctcctgcaacgcttattcggagtttgaatgtggaaatggtgagtgcattgactaccagctcacctgtgatggcattcctcactgtaaagataaatcagatgaaaaactgctctactgtgaaaacagaagctgtcgaagaggcttcaagccatgctataatcgccgctgcattcctcatggcaagttatgtgatggagaaaatgactgcggagacaactctgatgaattagattgtaaagtttcaacctgtgccacggttgagttccgctgtgcagatgggacttgtattccaagatcagcacgatgcaaccagaacatagattgtgcagatgcttcagatgaaaagaactgcaataacacagactgcacacatttctataagcttggagtgaaaaccacagggttcataagatgtaattctacctcactgtgtgttctgccaacctggatatgcgacgggtctaatgactgtggagactattcagatgaattaaagtgcccagttcaaaacaaacacaaatgtgaagaaaattattttagttgtcctagtggaagatgcattttgaatacctggatatgcgatggtcagaaagattgtgaggatggacgtgatgaattccactgtgattcttcttgctcttggaaccaatttgcttgttccgcacaaaaatgtatttctaagcattggatttgtgatggagaagatgactgtggggatgggttagatgaaagtgacagcatttgtggtgccataacctgtgctgctgacatgttcagctgccagggctctcgtgcctgcgtgccccgacattggctttgtgatggtgaaagggactgtccagatggaagcgatgagctttccacagcaggctgcgctcccaataatacatgtgatgaaaatgctttcatgtgccataataaagtatgcattcccaagcaatttgtttgtgaccatgatgacgactgtggagatggctctgatgagtcaccgcagtgtggatatcgacagtgtggtacagaagaatttagttgtgctgatgggcggtgtcttctaaatactcaatggcagtgtgatggagactttgactgtcctgaccattctgatgaagcacctttaaacccaaagtgtaaaagtgcagaacagtcatgcaacagttcattttttatgtgcaaaaatggcaggtgcattcccagtggaggtctttgcgacaataaggatgactgtggcgatggttcagatgagagaaactgccatataaatgaatgtttgagtaagaaagtcagtggatgttctcaagactgtcaagaccttccggtcagttataagtgcaaatgctggcctggattccaactgaaggatgacggcaaaacatgtgtagacattgatgaatgctcttcaggctttccctgtagccagcaatgcatcaatacatacgggacttacaagtgcctctgtacagatgggtatgaaatacaacctgataacccaaatggctgcaaatcgctctcagatgaagaaccttttttaattcttgctgatcatcatgagataaggaaaattagcactgatggctccaactacacacttttaaaacagggattaaacaatgttattgctatagactttgattacagagaagaattcatctattggatcgattctagccgacccaatggcagtcgcataaatagaatgtgtttaaatggaagtgacattaaggtagttcataacacagcggtccccaatgcacttgctgtcgattggattggaaaaaacctctattggtctgacacagaaaaaagaatcattgaagtatccaaactcaatggcttgtaccctactatactcgttagcaaaaggctgaagtttcccagagacttgtctttagatcctcaagctggatatttgtattggattgactgctgcgagtatcctcatattggccgtgttggaatggatggaaccaatcagagtgttgtcatagaaaccaagatttctagacctatggcactaacaatagattatgttaatcgtagactctactgggccgatgaaaatcacattgaatttagcaacatggatggatctcatagacacaaagtccctaatcaagatattccaggggtgattgcactaacattgtttgaagactacatctactggactgatgggaaaaccaagtcactcagccgtgcccataaaacatcgggagcagacagactctcactgatttactcatggcatgccatcacagatatccaggtgtatcattcttatagacaacctgatgtctccaaacatctctgcatgataaataatggtggttgcagtcatttgtgccttttagcccctggaaaaacccacacttgtgcatgtcccactaacttctatctggcagctgataataggacttgcttatccaactgcacagccagccagtttcgttgcaaaactgacaaatgtattccattctggtggaaatgtgacaccgtggatgactgtggtgatggatctgatgaacctgatgactgtcctgaatttagatgtcagccaggccgatttcagtgtgggactggactctgtgctctaccagctttcatctgtgatggagagaatgattgtggagacaattctgatgaactcaactgtgacacacatgtctgcctgtcaggtcaattcaaatgtaccaagaaccagaaatgtatcccagtaaacttaagatgtaatgggcaagatgactgtggtgatgaggaagatgaaagagactgtcctgaaaacagctgttctccagactatttccagtgtaagactacgaagcattgcatttccaagctgtgggtttgtgacgaggatccagactgtgcagatgcatcagacgaggccaactgcgataaaaagacttgtggacctcatgaattccagtgtaaaaacaacaactgtattcccgatcactggcggtgtgatagccaaaatgactgcagtgataattcagatgaagaaaactgtaagccacagacatgtacattgaaagatttcctctgtgccaatggggactgtgtttcttcaaggttttggtgtgatggagattttgactgtgcagatggctctgatgagagaaattgtgagacaagttgttccaaagatcagttccggtgttccaatggtcagtgtataccagcaaaatggaaatgtgatggccatgaagactgcaaatatggggaagatgagaaaagctgtgagccagcttctcctacttgctcatcacgtgaatatatatgtgccagtgatggatgtatttcagcatctttgaaatgtaatggagaatatgattgtgctgatggttcagatgagatggactgtgtgactgaatgtaaggaagatcagtttcggtgcaaaaataaagcccactgtattccaattagatggctgtgtgatggaattcatgactgtgtggatggcagtgatgaagagaactgtgaaagaggaggaaatatatgtagagctgatgagttcctttgcaataattctctctgcaaactacatttctgggtgtgtgatggagaggacgactgtggagacaactctgatgaagcccctgatatgtgtgtcaaatttctttgtccatccacgagacctcacagatgcagaaataacagaatatgcctacagtcggagcaaatgtgcaatgggattgatgaatgcggtgacaattcagatgaagatcactgtggtggtaagctgacatataaagcaaggccttgtaaaaaggatgagtttgcttgtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaagagatatgattatttggagtactcagtttaatccaggcggaattttctacaaaaggatccatggcagagaaaaaaggcaagcaaacagtggcttgatttgtcctgaatttaaaaggcccagggacattgcagttgactgggtggctggaaacatttactggactgatcattctagaatgcattggttcagttactacactactcactggaccagtctgaggtactctatcaacgtagggcagctgaatggccccaactgcaccagactcttaacaaatatggctggagaaccctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtgttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtcttttagatcctggctttatgatagacccaacaaaggccaggtacatagggggaggacccagtgctttcaagcttccacacacagcgccgcccatctacctaaactctgatttgaaaggaccactaactgctgggccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcttttatatgctgtataaatgtataaaatataaggattacttttgtatgttccaacagtattatacttgttttggcatcagcattacctctttctttatctttttcctggttaattgttttctgagttttttgggttttattttttgctgatgactattgattgaccatttgtatggtatttttatgaaaaagaactgcactacagtacaatttacaacaatgctgctgatatgacacacctttgaatttgttaaaattaaaaacaacgtattcctttgtagtgtgaatatgagcaatctattttatatgaacttttttggttgtacttaatcaacgaggagaatctctgcacttttccattatacggtttgaaggctgtaatacagtgtcatattatttttctgtttaaattgatggaaaaatgattgaatggtcaactctcttctttgtgcccataaagatcgattcagactctgctgaaaatatatagctctcacaagttcagcatcacctgctttgaaattagccttagattgccaaccaatagatgagaattttgaggaaaaaaattaaaaatatgtaaaattaataatttgcatgaacacagatgactacattttccaaaacttagtggactctatgtgatgtactaaatgtatacaccttgtaagcaatagttatatttaggtggtagaacatagcaaaaatataaccgaaagttggccgactgcacttgctatggaataagaccttttattctccctcagtctcgagataaatagccagcctagagcacaacagggcattgggtacttgcatcttaggtatttcttcccagtcacatccattttgtggaagattaacccaaccccttacactacactgaacactaaagaataatatataagcacacaaattggtgacagaatttcaattacgtgaacgcatcctctttgctaggtcaaaaaacaaagggcaaagcagacattttagtatacagagtgattggcaaatattttcaagatttaatatgagcaacccattatttgccctatccaaaatatattcaagggccttccaagttgtagaagaacaatgatcttcccataatcaaaagtggagagtcgaaatgctgtgccagttgctctggtattcaggtttctctgggttttacagaacgcatggaccccattcacgtttggtttgtttatcttcaaatttgagttgaaacgagtgcgatttatttaagttgtatataaaaataaaaggatagcatttttatacaaatatctttaaaggcacaaaagatttattcacaagttttggagggctttttgttcctctgatagacatgactgacttttagctgtcataatgtattaacctaacagatgaaatatgttaaatatgtggttgctctttatccctttgtacaagcattaaaaaaactgctgttttataagaagactttttgttgtactatgtgcatgcatactacctatttctaaactttgccatattgaggcctttataaactattgatttatgtaatactagtgcaattttgcttgaacaatgttatgcatatcataaactttttcaggttcttgtttaagtacattttttaaattgaacagtatttttcattttggttataatatagtcattttgcctatgtttctacaatgaagtgttaaatactttataaaaaattgttgactgacttatttaaatgaaattctacat

SEQ ID NO: 2301 - DNA, 1489 bp, Homo sapiens
cagcctggcccttatctgcactgggccagcatcctccggccgctgcgccgccaggggtgagagggaggaaaccgggccgccgggggcggggagaaggcgggccggcccgggagccgctcactttccctgggggggacctacgcggagacctcggctatcctggccttccgaggcccacgaggaggcgcggcccaacgccggggcctggagcattgaggccggaccctcgcgagacagcagagcctggcctgacgctggaaaccacaccctggcccagactgccagccctgacgggacagagccagggcactcaccaggctgcaagaacagtgctggggtgagtacccccacgtcggggtccatgtgcccgcctcaggcacaggcagaggtgggccccaccatgactgagaaggcagagatggtgtgtgcccccagcccagcgcctgccccaccccctaagcctgcctcgcctgggcccccgcaggtggaggaggtgggccaccgaggaggctcctcgccccccaggctgccacctggtgtaccagtgatcagcctgggccacagcaggcccccaggggtagccatgcccaccacagagctgggcactctgcggcccccgctgctgcaactctccaccctgggaactgccccgcccactttggccctgcactaccaccctcaccccttcctcaacagtgtctacattgggccagcaggaccttttagcatcttccctagcagccggttgaagcggagaccaagccactgtgagctggacctggctgaggggcaccagccccagaaggtggcccggcgcgtgttcaccaacagccgggagcgctggcggcagcagaacgttaacggcgccttcgccgagctgaggaagctgctgccgacgcacccgcccgaccggaagctgagcaagaacgaggtgctccgcctagccatgaagtacatcggcttcctggtgcggctgctgcgcgaccaagccgcagctctggccgcaggccccacccctcccgggcctcgcaaacggccggtgcaccgggtcccagacgacggcgcccgccggggatccggacgcagggccgaggcggcagcgcgctcgcagcccgcgcccccggccgaccccgacggcagccccggtggagcggcccggcccatcaagatggagcaaaccgctttgagcccagaggtgcggtgaccgcacgcggcagcacctctgagccggagggcaccagggactcggcccagggccgtcaaggaaagggcagtggacgtgctgcgcatgttcgggagcgaactcccccgaagaaggaccagtgaagacgtcaggggcaaggtctcgggggtccggaagggtgatcatcgacccccaagggacccgcagacccttaaaaaaatcacccacaaccctctggaagtggccttgcccggtccccttcccaggggcgaggtcggcaaagcaacatggcagagcagtcatagg

SEQ ID NO: 2302 - DNA, 2166 bp, Homo sapiens
gagggctcagagggagcaccggtttggagctgggaccccctattttagcttttctgtggctggtgaatggggatcccaggatctcacaatctcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgacacacttctagactcccagttggaggagaaaggtctgggggcctccccctggggcaacttgggccagcaactcttgcttctgcccacagggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgtt

SEQ ID NO: 2303 - DNA, 2117 bp, Homo sapiens
aagtcagggtgggacgtgggcgcggggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 2304 - DNA, 1551 bp, Homo sapiens
atgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaaggtgaccccaggcagcagggcctgaaagacaaggcctgcggatccctggctgttggcttccacctctcccccacctactttctccccggtcttgccttccttgtcccccaccctgtaactccaggcttcctgccgatcccagctcggttctccctgatgccccttgtctttacagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttga

SEQ ID NO: 2305 - DNA, 1914 bp, Homo sapiens
gagacaggtggtggctacgacggcgaagggagctgagactgtccaggcagccaggttaggccaggaggaccatgtgaatggggccagagcacagctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgt

SEQ ID NO: 2306 - DNA, 2059 bp, Homo sapiens
atggggatcccaggatctcacaatctcaggtacttttggaactttccagggcaaggccccattatatctgatgttgggggagcagatcttgggggagccccttcagccccctcttccattccctcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgt

SEQ ID NO: 2307 - DNA, 3068 bp, Homo sapiens
aagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattgtcattt

SEQ ID NO: 2308 - DNA, 3477 bp, Homo sapiens
agcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattgtcattt

SEQ ID NO: 2309 - DNA, 1488 bp, Homo sapiens
acagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcactt

SEQ ID NO: 2310 - DNA, 1472 bp, Homo sapiens
actagtcctgcagggtggaaggcgctttatcgggtcttctggcccgctgcgggcgatagagctggtaacctgagtagagtaaatagagacacgtgggtgctggctagagaaagcgcggagcagggccgcgctggagggctgtttgaagcctagtccagagctggtctagggggcggatggaccctgatacccgacactccactggtcacccttgttccacaactgggaaaccctctggaggaaatccggtagaaaagtcctgacacccgaatgatttaaccaacgccttttccctccaaagaaacttggaggatatacctttttttccttaaatggcatctttctacccccaaaaagaaagtgtgtggttttgagggcggggacattttgggttttaaacagcgcgtttaagaacacctcagatctgccttctctatcccaatggcagaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcg

SEQ ID NO: 2311 - DNA, 2504 bp, Homo sapiens
aaagggggagttgtaagagaggcggtatcaacagcctgctgatgaaagaggcgactctgcagaaagaggcaacttgacatatcaggactttaaccgctgtagaaatagctcaggcataccaagcccatgcaaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaaccttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactgtttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggg

SEQ ID NO: 2312 - DNA, 2208 bp, Homo sapiens
tgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaaagcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaaccttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactgtttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttgcctttatctccccaactaaaatacaatggggaagaagtctgcc

SEQ ID NO: 2313 - DNA, 2193 bp, Homo sapiens
aaacacagaattgcagaagttcaggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagaagctttttagatgaggaatttcctcactatgattccctgtcctgcgcagatgcaattcaacaacctcttcaagaaaaattgcagtgttgccacaaactatatggtggtcaagaagcaagaatacatcagacacccctgaccttgaaacatacgtgctggtacacacctctgctgggtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccacgatagaggcccaaggcacaagtccagctcatgataatattgcattccaagactctacgagtaaggataaaaccatattaaatctggaagccaaagaggaaccagaaacaatagaagaacataaaaaagaacatgcttcaggagactctgtggtttcccctcttcctgtaaccactgtgaaatcggttaaccttagacaaagtgagaacacttctgctaatgagaaggaggtggaggcagaatttctcagattatctttgggatttaagtgtgactggtttaccttggagaagagagtgaagcttgaagagaggtcccgtgacttggcagaagaaaatttgaagaaagaaatcactaactgtttaaaactattagagtctttaacacctctgtgtgaagatgacaaccaggcacaggaaatcattaagaagctggagaagagtataaagtttcttagccagtgtgcagcacgagtggccagtagggctgagatgttgggagccatcaatcaggaaagccgggttagtaaagcagttgaagtgatgattcagcacgtagaaaacttgaagaggatgtatgccaaagagcacgctgaattagaagaactgaaacaggttcttctgcagaatgaaaggtctttcaatcctcttgaagatgatgatgactgccaaattaaaaaacgttcagcttctctaaactccaagccatcttctctacgaagagtgactattgcctctttacccagaaatattggaaatgcaggaatggtggctgggatggaaaataatgatcgattcagtagaaggtcaagcagttggcgtattttggggtcaaagcagagtgaacaccgtccctcattacctcgatttattagcacctattcctgggcagatgctgaagaagaaaaatgtgaactaaaaactaaagatgactcagagccatctggagaagaaacagtagaaaggacaaggaagccaagtctttctgaaaagaaaaataatccatcaaagtgggatgtctcttcagtttatgacacaatagcttcctgggcaacaaatctcaagtcctccatcagaaaggctaataaggccctctggctctctattgcattcattgtactgtttgcagctttgatgagcttcctcacaggccaattattccagaagtctgtggatgccgctcccacacagcaagaggactcatggacgtctctagaacatatcttgtggccatttaccagactccgacacaatgggccaccaccagtgtgacagcaggacatcctaatatatggatcttgatttttaagtttcagtatctgaacttcgtaaattagtaacttttagctgggaaagtatagcatgaaaccagaggttctcagaatgactgtaagatagcttacatttcctctttttg

SEQ ID NO: 2314 - DNA, 785 bp, Homo sapiens
attttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagacaacaattgagtcacttcaaaaggagttcattgaaggggaacaccatggcttgctgtttcagagctttttagatgaggaatttcctcactatgattccctgtcctgcgcagatgcaattcaacaacctcttcaagaaaaattgaagcagtgttgccacaaactatatggtggtcaagaagcaagaatacatcagacacccctgaccttgaaacatacgtgctggtacacacctctgctgggtgcccaggccccacaagtggccccagcccaggaacgaatctctcaggctgcatcaggatgaatgatgacccaagtatggaagagaatggtgttgaacgcgtgtgtcctgagagcctgctgcagtccagggaatattcctcactaccattacccagacacacttcatcgacagacggtactataacttcaagtgatcctggattagaaattctgaatatggcttcttgtgaccttgacagaaactcgctctgtaagaaagaggaggatacaagatcagcttctcccac

SEQ ID NO: 2315 - DNA, 759 bp, Homo sapiens
ggagaggcttatcacttccctgagaagaaaaacacattttcagttttgcctgcatcataagagtgagcactccattgctttctttcctggccacactgctacaatccagcactaactatccatgtccagggtaaggatcgagatcgagaagcccacactgccagtgaaaaagctacgtctttactgcataaattagaggaagcaatttcggaacaacggaaccttcaaactataaatactgaattatcgaacacttgccaggcacttcagcagaagacaaggaaactgaagacaacaattgagtcacttcaaaaggagttcattgaaggggaacaccatggcttgctgtttcagagctttttagatgaggaatttcctcactatgattccctgtcctgcgcagatgcaattcaacaacctcttcaagaaaaattgcagtgttgccacaaactatatggtggtcaagaagcaagaatacatcagacacccctgaccttgaaacatacgtgctggtacacacctctgctggatgccttatctctggatagttttacagcagttccaaccctggaatcaacacctttctcaggtgtagccaaccaaatccacactctgtgtgaaaggcccacatatggagaagtaaaggatggtgctttggatgtaaaaagacaacacaagtgcccaggccccacaagtggccccagcccaggaacgaatctctcaggctgcatcaggatgaatgatgacccaagtatggaa

SEQ ID NO: 2316 - DNA, 1422 bp, Homo sapiens
ccaggggctccgcacagcaggtgaggctctcctgccccatctccttgggctgcccgtgcttcgtgctttggactaccgccccgcagtgtcctgccctctgcctgggcctcggtccctcctgcacctgctgcctggatccccggcctgcctgggcctgggccttggttctccccatgacaccacctgaacgtctcttcctcccaagggtgcgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 2317 - DNA, 1507 bp, Homo sapiens
tcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggttctccccatgacaccacctgaacgtctcttcctcccaagggtgcgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaa

SEQ ID NO: 2318 - DNA, 554 bp, Homo sapiens
gccccatctccttgggctgcccgtgcttcgtgctttggactaccgccccgcagtgtcctgccctctgcctgggcctcggtccctcctgcacctgctgcctggatccccggcctgcctgggcctgggccttggttctccccatgacaccacctgaacgtctcttcctcccaagggtgcgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggggtcgtcaccacctctcctttggccattccaacagctcaagtcttccctgatcaagtcaccggagctttcaaagaag

SEQ ID NO: 2319 - DNA, 2260 bp, Homo sapiens
gctttcccggccgcccctcccgccccgcatcgaggcagacaagcctgttcctcttccctgggctgcgattgcgacaggccggcctggctcccagcgctccctgtccccgccccgcggccagctcgctccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggccgggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgactgagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggac

SEQ ID NO: 2320 - DNA, 2088 bp, Homo sapiens
ccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccactgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggccgggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgactgagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacct

SEQ ID NO: 2321 - DNA, 2358 bp, Homo sapiens
gttgcttattcattcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgtcctcgaggccgtgggaagagaagcacgcccagggggccactcctgagagcctctctgtccaccaggcctctgcagaggggtcaccatggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtctccctgacttggtcccagaccccaactatgtgcaagcatccacttatgtgcagagagcccacctgtactccctgcgctgtgctgcggaggagaagtgtctggccagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacaggtcgctacgtttctgcaacaaactgcaaaattgtccaatcctgatctccgggagggacagatggccaatctctccccttccaaagcaggccctgctccccgggcagcctcccgccgaggggcccagcccccaacccacaggcacggaggggcatccctccctgccggcctcagggagcgaacgtggatgaaaaccacagggattccggacgccagaccccattttatacttcacttttctctacagtgttgttttgttgttgttggtttttattttttatactttggccataccacagagctagattgcccaggtctgggctgaataaaacaaggtttttctac

SEQ ID NO: 2322 - DNA, 1953 bp, Homo sapiens
attcagagtgggaaagcgccagccgagcggccagccagtgcggggctggccatgtaaggcccacaggcggtcctgcccgcccggtgccctgcggagagcctcgtgcagccctgggcaccgcccctgccctgccctgaccccttggccttgaaatgctgtcatcggaggagccgtcccgctcgggacaaggccagcatggacaaagctagagctggggcaagcaaggagccttcctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtctccctgacttggtcccagaccccaactatgtgcaagcatccacttatgtgcagagagcccacctgtactccctgcgctgtgctgcggaggagaagtgtctggccagcacagcctatgcccctgaggccaccgactacgatgtgcgggtgctactgcgcttcccccagcgcgtgaagaaccagggcacagcagacttcctccccaaccggccacggcacacctgggagtggcacagctgccaccagcattaccacagcatggacgagttcagccactacgacctactggatgcagccacaggcaagaaggtggccgagggccacaaggccagtttctgcctggaggacagcacctgtgacttcggcaacctcaagcgctatgcatgcacctctcatacccagggcctgagcccaggctgctatgacacctacaatgcggacatcgactgccagtggatcgacataaccgacgtgcagcctgggaactacatcctcaaggtgcacgtgaacccaaagtatattgttttggagtctgacttcaccaacaacgtggtgagatgcaacattcactacacaggtcgctacgtttctgcaacaaactgcaaaattgtccaatcctgatctccgggagggacagatggccaatctctccccttccaaagcaggccctgctccccgggcagcctcccgccgaggggcccagcccccaacccacaggcacggaggggcatccctccctgccggcctcagggagcgaacgtggatgaaaaccacagggattccggacgccagaccccattttatacttcacttttctctacagtgttgttttgttgttgttggtttttattttttatactttggccataccacagagctagattgcccaggtctgggctgaataaaacaaggtttttct

SEQ ID NO: 2323 - DNA, 1852 bp, Homo sapiens
gaggaggggcggcgggtggcgggctcgactgcccccagccgaggggcagccccggggccgggcccggcgcgcacccggccagcgcgccctcgccagctgcgctctgagttctgggccagctccccagaggcctaggcgccgccgccgcgagggcgcggggcagacaaaggaggcagacaaaggcgggcgcagcccagcagccgtgcgggcaccgggcgaggcaggcccactcctcccgtaatatcatctctgagggcccttacaggacttccagaccgagtccacgcccctgggggacttgggagcagtaaaatgtagtggcaggaggcacctcggccatcgcccaccccaccagctgggagactcgggcaggttattcacccttctgcacctcgcttgacttatctgtataaagagaacagtcacagtaactgcctcatggagttactcccaggactgagataatccacggacacacttagcccagtgcccagcactcggctggagctccaaaaagccctcttccggcgcctgctaaagcgagagaaatgccctcgggggaagatatgtagcgatccaatggaacgtggagatcaacgttgtgttttcttcgcgcccacccgaagttgaagggaggtggcgcggcgggtctcagcccctcccggacgccgaggcccggcccccgcccctcggagacccgcccccgcatgcggaaccgccctctgcgaggcccggtttgggccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggc

SEQ ID NO: 2324 - DNA, 1095 bp, Homo sapiens
ccgggcccggcgcgcacccggccagcgcgccctcgccagctgcgctctgagttctgggccagctccccagaggcctaggcgccgccgccgcgagggcgcggggcagacaaaggaggcagacaaaggcgggcgcagcccagcagccgtgcgggcaccgggcgaggcaggcccactcctcccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaaggtgagggtgcactgggctccccagccatctcaccccatgctcacccccgtccctgtgtgctcacagtccaactctgggatggggtgaagctaggactctgtggggtcttcatggctccaatacccagaagcctgttccctgcactctggagaccatcccaacccaggggcaggccccaaggcatgcgggccatgttcagggtgccttgggcctgggagcccgggttggagctggctctaagtaggggctgccccagagggttcggggttcttctcacatccgtcccctgttctccacgctaaacgttctgtctgagctgagcccctcagggtttcttccccatctagtcctgatctcagacttcctgggaccttccctatggggcccgggcattctctcagcctacaccactcatgctggagggtgccggcttctcaaactcgctatctggcctcttggggacccccagcctagcagctgagcagggctgtgagtgggccgtttctcctccttccttgggcaagggggtggaggcagggtggtgtagtcggggtggggtgcctggctctgcagtgggggttcctctctttgcagaatgatgtggagaaagtggtggtggtgattttggataaagagcaccgcccagtggagaaattcgtctttgagatcac

SEQ ID NO: 2325 - DNA, 910 bp, Homo sapiens
gcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggtgtgtccactccccaccctctcttcccttggcatttccatggttatctcgggttggtctgtgttcccaggtccatgtttggctgttctgagactcatctcttcctaaccctgagagtccacctcctctgggaagcttccctgattgattctacctggcttccatctccctattgactggggcttttcttagcacttgctttgccatctgctctgggggtgctgctgagccagcaagggaagtgggaagaggctgggcccagtggctggcaccagggcggtgggggagcctccaccaacctcttgcctctccaggctgtaccttcacagtcctggtgcacacgagagaagccgccactcgcaacatggagaagatccaggtcatcaaggtgagatgagatgggtctgggtctgggcgcaggctctagaaacgtgatgtcgcagttccaggcgggcaggggcactgcctgt

SEQ ID NO: 2326 - DNA, 872 bp, Homo sapiens
aggggcagccccggggccgggcccggcgcgcacccggccagcgcgccctcgccagctgcgctctgagttctgggccagctccccagaggcctaggcgccgccgccgcgagggcgcggggcagacaaaggaggcagacaaaggcgggcgcagcccagcagccgtgcgggcaccgggcgaggcaggcccactcctcccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcc

SEQ ID NO: 2327 - DNA, 864 bp, Homo sapiens
gggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcaggtgggctgcccctgcccctcgcccactagctggcatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctct

SEQ ID NO: 2328 - DNA, 1002 bp, Homo sapiens
cagacaaaggcgggcgcagcccagcagccgtgcgggcaccgggcgaggcaggcccactcctcccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcaggtgggctgcccctgcccctcgcccactagctggcatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatact

SEQ ID NO: 2329 - DNA, 1118 bp, Homo sapiens
ccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtctgcttggaggatgcctcccccaggagggcagtgagggatgccgcaacctcgacttctcagcctcctggggttccgccggccaacactgtctgtctcaaatactgtgctgtgagttgtttcaataaaggggccccaagggctgggctg

SEQ ID NO: 2330 - DNA, 678 bp, Homo sapiens
gcgatcggtccggtcggtggctccccgcggcggggccgggcccgatctcgggcgggaaccgagcgcagagccggtagcgggaaggatgaccacgctcacacgacaagacctcaactttggccaaggtagggaggctggacctgcgggcccgggggcgggggcgtctgggccggcgggcttcctcgagcgcgccaccggcttgtgcccccctgcagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggt

SEQ ID NO: 2331 - DNA, 1032 bp, Homo sapiens
ccccgggttgagcgggaggcgcgatcggtccggtcggtggctccccgcggcggggccgggcccgatctcgggcgggaaccgagcgcagagccggtactgggggaggggagagggggcgggattcccgccgggagggatccggcgtagcagggggcggagtcttattccaaccccgcttcgctttccgcatgtcccgctttgcgctcccggccctgggcatcccgctgtttccctctgcgtccgcggccctgcccttttcgggggcacagctgtggtctttccaccccgcgagacagcggggcgagggggcgcgggcggccagtggatagaggctgatgcccccaagcacggacgccagcgtgggggtggaggttcttccagctgccctgagcctgtgcgaagcgggaggtccttccccagttcccacagactgtggggagggaagagacggtggaagcgagcgggttctgggctcctgggtctctggaactaccctctgcccttgccccaacactcaggtagcgggaaggatgaccacgctcacacgacaagacctcaactttggccaagtggtggccgatgtgctctgcgagttcctggaggtggctgtgcatctcatcctctacgtgcgcgaggtctaccccgtgggcatcttccagaaacgcaagaagtacaacgtgccggtccagatgtcctgccacccggagctgaatcagtatatccaggacacgctgcactgcgtcaagccactcctggagaagaatgatgtggagaaagtggtggtggtgattttggataaagagcaccgcccagtggagaaattcgtctttgagatcacccagcctccactgctgtccatcagctcagactcgctgttgtctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaagg

SEQ ID NO: 2332 - DNA, 6414 bp, Homo sapiens
ccggcgggcggcgctgccgcttcccaatcgcgccctcccagcgccggggacgcggcgcccgcgctcccgcccgagcccggggaaacggagacaaggaggcgccgccgccccctccccgcggctgcgccccagccctgcgcccgcagcatgcccgccgccgggccgagcgccgccctcccccaggagctcgaggaggcgacgccgctgccggccgcgggaccgcggctgcgagggtagcggggccggagccgggccccccgaggcgccgcgcggcgggcggagagggaggaggagcaggcatcctccgcggcgcgcgggcggcggccctgctgcccggcgcgcccatggcccggccgcagggagaatgcaagctgctctccacgcgctcggcgtcccccggagccgctcgcgtcgccgccgccccctagccgccagcgctcggccgctggctgcgctaggacccgcggccgccggccgccgagcgcgggagggcaggcaggggcaggagccggagggcccggggcgcggcgcggcatgtagctgcgggctcccgcgtccgcgtgaggctgtcggcccggggccccgccatggctgggatggacagtggcaacctgaagaccgcgaggctgtggcgggacgccgccctgcgtgccaggaagctgcggagcaacctgcgccagctcacgcttaccgccgccggggcctgccccggggccggggccgacgcgctcgagtcccccgcctccccccagctcgtgctgccggccaacctcggggacattgaggcactgaacctggggaacaacggcctggaggaggtacccgaggggctggggtcggcgctgggcagcctgcgcgtcctggtcctgcgcaggaaccgcttcgcccggctgcccccggcggtggccgagctcggccaccacctcaccgagctggacgtgagccacaaccggctgaccgccctgggcgcggaggtggtgagtgctctgagggagctgcggaagctcaacctcagccacaaccagctgcccgccctgcccgcccagctgggcgctctcgctcacctggaggagctggatgtcagctttaaccggctggcgcacctgcctgactccctctcctgcctctcccgcctgcgcaccctggacgtggatcacaaccagctcactgccttcccccggcagctgctgcagctggtggccctggaggagctggacgtgtccagcaaccggctgcggggcctgcctgaggatatcagtgccctgcgtgccctcaagatcctctggctgagtggggccgagcttggcacgctgcccgccggcttctgcgagctggccagtttggagagcctcatgctagacaacaacgggctgcaggctctgcccgcccagttcagctgcctgcagcggctcaaaatgctcaacctctcctccaacctcttcgaggagttccctgccgcgctgctgcccctggctggtctggaggagctctaccttagtcgcaaccagctcacctcggtgccatcccttatctcgggcctgggccggcttctcaccttgtggctggataataaccgcatccgctacctgccggactccatcgtggagctgaccggcctggaggagctcgtgctgcaggggaaccagatcgcggtgctgcccgaccactttggccagctctcccgggtgggtttgtggaagatcaaagacaacccactgatccagcccccctacgaggtctgcatgaaggggatcccctacatcgcagcctaccagaaggaactggctcattcccagccggcggtgcagccccggctcaagctgctcctgatggggcataaggctgcaggaaagactttgctgcgccactgcctcaccgaggagagagtggagggatgcccaggaggaggggacaaggagaagtgctacccaccgtcacctccccctgtgagcaagggcatcgaggtgaccagctggacggccgatgcctcccggggcctgcggttcatcgtgtatgacttagctggggatgaaagttatgaggtgatccagcccttcttcctgtccccaggggccctatacgtgctggtggtcaacttggccacctatgagcctcgccactttcctaccaccgtgggctccttcttgcatcgggtcggggcgagagtgccccacgcggtggtgtgcatcgtgggcacccacgcagacctgtgcggagagcgtgagctggaggagaaatgtctggacattcaccgccagatcgccctgcaggagaagcacgacgcggagggactgagccgcttggccaaggtggtggacgaggcactggcccgggacttcgagctgcgctctgccagcccccacgcagcctactatggcgtttcggacaagaaccttcgacggcgcaaggcccattttcaatacctgctcaaccaccggctgcagatcctctcccccgtgttgcctgttagctgcagggacccgcgccacttacgacgccttcgggacaagttgctgtcagttgctgagcaccgagagatcttccccaacttacacagagtactgcctcgatcctggcaggtgctggaggaactgcatttccagccacctcaggcccagcgactgtggctaagctggtgggactcggcgcgcttgggcctgcaggcgggtctgaccgaggaccgactgcagagtgccctctcctacctgcatgagagcggcaagctactctactttgaggacagtccggctctcaaggagcacgtcttccacaacctcacccgcctcatcgacatcctcaatgtcttcttccagagggatccctctttgctgctgcataagctgctcctagggaccagtggagagggcaaggcggagggggaaagctccccgcccatggcgcggtccacccccagccaggaactgctccgggccacccagctccatcagtatgtggagggctttctgttgcatgggctcttgccagctcatgtcattcggttgctgcttaagcctcatgtccaggcccagcaggacttgcagctgttgctggagctgctggagaagatgggactctgttactgcctcaataaacccaagggcaagcctttgaatgggtccacagcttggtacaagttcccatgctatgtgcagaacgaggtgccccatgcagaagcctggattaatgggaccaacctagctgggcagtcttttgtggctgagcagttgcagattgaatatagctttccttttacttttccacttgggttgtttgcacgctacagtgtccagatcaacagccatgtggtgcacaggtcggatggtaaatttcagatctttgcctatagagggaaagttcctgtggttgtgagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccaggggagttgctgagtcagcccagaccggaaggagtggcagagatcatttgccccaagaacggcagcgagcgagtaaatgttgccttggtttacccacccacgccgactgtgatcagcccctgttccaagaagaatgttggtgaaaagcacagaaaccagtgacgtttgtggctgtggaatttccatggagaaaagagagcatctgaacacctggaccatcttttgcacctggcagaccctctgcactcaccccagcgtgttctgtgaacttgagtgacaacgcgtgcttgcagggtgctttttggacgactggggaagaggtggggagggggtggtggggggaagcatggacgagaacatggagcaaatgttttacaacctgaacctcagaactgtgatcctccaaggagcgcgctacttgaagaaaagaaaaaaaaaaaaaaaaagtcgaatggcttctcagggattttgttttccgtgcacatataagccatagttacagtacaggtggcagtatttagagcactcagatttcagttctgttaaatgtgaaagagggatcgactgacgttcattgctgttccataactagtgtaaaatatgtatatgtttatctttatttttataatatgcaaatacatttaaatttatacagtttgaagcttctagcgttagttcacactgggtgcaatattctgcatgagaactgtgccaagatggggctgatttcttattttagtataagacttttttgttttttctttattctttaatcctcttcacattaaaaaaaaaatctctctgttagcccatggattaagtgttggttcatagagattgccaataatcagaaagaaccttaaatgtgcatttaagacagtgtcccttcccttcttttcaatgaaggtccctgcctatataaatcatctggcacgctggtgggaaatcctttgctcttccaacgtgttattagtgctgggcagagatggggcacactcaggggccaaagaggacaaaaagtccatgcaaaacttgagtcttttaatggcttaagataatcaggagtcagttctgaatcttacaaagtgctctgcttaataagtaccttacttagcagagcactttgcaaacatattacttattagcagagctctttgtagaccttccacatctggctgtcagatcttaaggttgtgaatttaggctccagttacattcactggagagcataatcccacacgggttatttataaatacagagcctctgattggacggtctcctgccaagaactagtaatacccttgttttaaaatcttcacaaggtaaaacttaaaaagccaaccaaacaaattgctctccattctacttttaattgggccaaacagcatatgctacagtagtaacatgtttttcggagagtgtaaaaaactctgtttacatttgcctcctccgtgggttgatcgaaaatgtataaaactgactgcttctcgccagcctcagacaagaagagtgagttgctggtactcgctactcttttacttcttttgtaaagtattgactcttggaaggctacagtatacaaagtctcaacatgttttttaaaagaaataaggagcaagcgactgccctgctagaaatcacaaaccgatttttgtagaatattttgtgccccaggcattaatttcactgactccagaacctgcagttcagagaatgatttcttatgatgataaaaatcgaatgggatcagacgatgtttgcatttttttaatacttgaataggacacctcaagtttgagatttcattttcttttagaacacagtcacaagattaatctggtgaatccttttgtcacagttctcgtgtgtgtgtgcgcgtctccgtgtgtgtgtgtgtgcatgtgtgtaaaactgaatggtcacatttaattgctttttggaccattgaatagttgggaagtaagaattttttaattggcatgagacggttcctcaactgttaaattaaccaactttgacctgtctttagaaaaaggcttatttgtatgattttgggctaactccccggggaccatattaaatgacaaaaatgctcctttgggtgacacaccctacaaagtatttgctgttacgaacataaacgcccacattcttaatatctaatatttttgaccagtgatgttttatgctgtcatctgaaccctagagaagcagtgtcagaggaaaccttggtgtcacatgtgtcttagcaaaagggttaccatgatcgagggtcatgtgaccaaaagatgctccagagaagcttgagaatttgtttcaagttgggaggagggttggagatacaaaaatcactctgctctacaggactcttcagctgtctatgcaagaaattccgttttctctttcagcacctggaaagacacagcagcccaccgaggcgataggtgattcactaagcacaagaggaatgttttctaagcaaggcgtcccttgcctctcaaacaaatgccctccaagtttgttagggtttctattcctgcaacttgtggtatcaaaaccacttcctggaattgtcaaagcactgccaaaataaatgtttttcccccttctaagaaaaaaaaaatgacagtgctcatatttgacacttgtgtattggactctcttttgaatgaataaaaaggaaaaggggtttggtgtaattcctgatggggtgcgtgttgtttttcatgccatggtttgtgaattttaattgtggtttcccatttcgttgttgtaactgggcagaaattaaaaaagaaaaatcaataaaaatacaaagaaatggttaaa

SEQ ID NO: 2333 - DNA, 1130 bp, Homo sapiens
taagatcctctttctctctcccccgcccctgccatcctgactccctaaggttttctatagtactatgctctcactcccaacttgaacacttctttaagctttccatccgtagtccttaattgggtttcagtccctccactcccattgttttttctccttacccctctttctcttttgccccctcccccaattctgtctccattcctagggttctaccaatcacatccgtgcactgtgatttagaggcatattctctgtagctgagaggggagccctgcgctcactgccatatgtttattagttatgaactgaataaaggaaggcttgacttcctgggtcatgggagtgaaggagtctgggtgacaggaagcaagcggcctgtcatgcctattgcctagctgccagattaaccttgccttgaaaataacgattgccccataggctattcagtgtaaggaagacaaaaattccttgggaacctactagtgggtttgccttccagatttggtagacgcaaaaagcaaagggggaacatgggcaaaggaagatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatc

SEQ ID NO: 2334 - DNA, 1018 bp, Homo sapiens
gctacctccaactgctgaggaaccggttgcctaaaaggagccggcaaaagcgcctacgtggagtccagaggagcggaagtagtcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatcatgttcaagaaatttgatgaaaaagaaaatgtgtccaactgcatccagttgaaaacttcagttattaagggtattaagaatcaattgatagagcaatttccaggtattgaaccatggcttaatcaaatcatgcctaagaaagatcctgtcaaaatagtccgatgccatgaacatatagaaatccttacagtaaatggagaattactcttttttagacaaagagaagggcctttttatccaaccctaagattacttcacaaatatccttttatcctgccacaccagcaggttgataaaggagccatcaaatttgtactcagtggagcaaatatcatgtgtccaggcttaacttctcctggagctaagctttaccctgctgcagtagataccattgttgctatcatggcagaaggaaaacagcatgctctatgtgttggagtcatgaagatgtctgcagaagacattgagaaagtcaacaaaggaattggcattgaaaatatccattatttaaatgatgggctgtggcatatgaagacatataaatgagcctcagaaggaatgcacttgggctaaatatggatattgtgctgtatctgtgtttgtgtctgtgtgtgacagcatgaagataatgcctgtggttatgctgaataaattcaccagatgctaaaattctgttagcttcagaaattattttaagttttcttaaactcaagttaaaattgggtagcaaacttggacattaaaaggtatctggtaagtaa

SEQ ID NO: 2335 - DNA, 2421 bp, Homo sapiens
cagcagaatggaagtgaggaaaggcaaccagctgacacaggagccagagtgagaccagcagactctcacactcaacctacaccatgaatttgtgtctatcttctacgcgttaagagccaaggacaggtgaagttgccagagagcaatggctctcttcactccgtggaagttgtcctctcagaagctgggctttttcctggtgacttttggcttcatttggggtatgatgcttctgcactttaccatccagcagcgaactcagcctgaaagcagctccatgctgcgcgagcagatcctggacctcagcaaaaggtacatcaaggcactggcagaagaaaacaggaatgtggtggatgggccatacgctggagtcatgacagcttatgatctgaagaaaacccttgctgtgttattagataacattttgcagcgcattggcaagttggagtcgaaggtggacaatcttgttgtcaatggcaccggaacaaactcaaccaactccactacagctgttcccagcttggttgcacttgagaaaattaatgtggcagatatcattaacggagctcaagaaaaatgtgtattgcctcctatggacggctaccctcactgtgagggaaagatcaagtggatgaaagacatgtggcgttcagatccctgctacgcagactatggagtggatggatccacctgctctttttttatttacctcagtgaggttgaaaattggtgtcctcatttaccttggagagcaaaaaatccctacgaagaagctgatcataattcattggcggaaattcgtacagattttaatattctctacagtatgatgaaaaagcatgaagaattccggtggatgagactacggatccggcgaatggctgacgcatggatccaagcaatcaagtccctggcagaaaagcagaaccttgaaaagagaaagcggaagaaagtcctcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggaaatcatgaagaaggttgtaggaaaccgatctggctgcccaactgtaggagacagaattgttgagctcatttacattgatattgtaggacttgctcaattcaagaaaactcttggaccatcctgggttcattaccagtgcatgctccgagtccttgattcatttggtactgaacccgaatttaatcatgcaaattatgcccaatcgaaaggccacaagaccccttggggaaaatggaatctgaaccctcagcagttttataccatgttccctcataccccagacaacagctttctggggtttgtggttgagcagcacctgaactccagtgatatccaccacattaatgaaatcaaaaggcagaaccagtcccttgtgtatggcaaagtggatagcttctggaagaataagaagatctacttggacattattcacacatacatggaagtgcatgcaactgtttatggctccagcacaaagaatattcccagttacgtgaaaaaccatggtatcctcagtggacgggacctgcagttccttcttcgagaaaccaagttgtttgttggacttgggttcccttacgagggcccagctcccctggaagctatcgcaaatggatgtgcttttctgaatcccaagttcaacccacccaaaagcagcaaaaacacagactttttcattggcaagccaactctgagagagctgacatcccagcatccttacgctgaagttttcatcgggcggccacatgtgtggactgttgacctcaacaatcaggaggaagtagaggatgcagtgaaagcaattttaaatcagaagattgagccatacatgccatatgaatttacgtgcgaggggatgctacagagaatcaatgctttcattgaaaaacaggacttctgccatgggcaagtgatgtggccacccctcagcgccctacaggtcaagcttgctgagcccgggcagtcctgcaagcaggtgtgccaggagagccagctcatctgcgagccttctttcttccagcacctcaacaaggacaaggacatgctgaagtacaaggtgacctgccaaagctcagagctggccaaggacatcctggtgccctcctttgaccctaagaataagcactgtgtgtttcaaggtgacctcctgctcttcagctgtgcaggcgcccaccccaggcaccagagggtctgcccctgccgggacttcatcaagggccaggtggctctctgcaaagactgcctatagcagctacctgctcagccctgcaccatgctgctggggaagacagtggcccc

SEQ ID NO: 2336 - DNA, 8252 bp, Homo sapiens
agcccaggtagccgcgccgcaggctcggggcgtcgcgacctcgcgcctcgggccgcgtgggcacggcggccggcgggtgctcccggctgctgctgctgcccaacaaggagcagaatggaagtgaggaaaggcaaccagctgacacaggagccagagtgagaccagcagactctcacactcaacctacaccatgaatttgtgtctatcttctacgcgttaagagccaaggacaggtgaagttgccagagagcaatggctctcttcactccgtggaagttgtcctctcagaagctgggctttttcctggtgacttttggcttcatttggggtatgatgcttctgcactttaccatccagcagcgaactcagcctgaaagcagctccatgctgcgcgagcagatcctggacctcagcaaaaggtacatcaaggcactggcagaagaaaacaggaatgtggtggatgggccatacgctggagtcatgacagcttatgatctgaagaaaacccttgctgtgttattagataacattttgcagcgcattggcaagttggagtcgaaggtggacaatcttgttgtcaatggcaccggaacaaactcaaccaactccactacagctgttcccagcttggttgcacttgagaaaattaatgtggcagatatcattaacggagctcaagaaaaatgtgtattgcctcctatggacggctaccctcactgtgagggaaagatcaagtggatgaaagacatgtggcgttcagatccctgctacgcagactatggagtggatggatccacctgctctttttttatttacctcagtgaggttgaaaattggtgtcctcatttaccttggagagcaaaaaatccctacgaagaagctgatcataattcattggcggaaattcgtacagattttaatattctctacagtatgatgaaaaagcatgaagaattccggtggatgagactacggatccggcgaatggctgacgcatggatccaagcaatcaagtccctggcagaaaagcagaaccttgaaaagagaaagcggaagaaagtcctcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggaaatcatgaagaaggttgtaggaaaccgatctggctgcccaactgtaggagacagaattgttgagctcatttacattgatattgtaggacttgctcaattcaagaaaactcttggaccatcctgggttcattaccagtgcatgctccgagtccttgattcatttggtactgaacccgaatttaatcatgcaaattatgcccaatcgaaaggccacaagaccccttggggaaaatggaatctgaaccctcagcagttttataccatgttccctcataccccagacaacagctttctggggtttgtggttgagcagcacctgaactccagtgatatccaccacattaatgaaatcaaaaggcagaaccagtcccttgtgtatggcaaagtggatagcttctggaagaataagaagatctacttggacattattcacacatacatggaagtgcatgcaactgtttatggctccagcacaaagaatattcccagttacgtgaaaaaccatggtatcctcagtggacgggacctgcagttccttcttcgagaaaccaagttgtttgttggacttgggttcccttacgagggcccagctcccctggaagctatcgcaaatggatgtgcttttctgaatcccaagttcaacccacccaaaagcagcaaaaacacagactttttcattggcaagccaactctgagagagctgacatcccagcatccttacgctgaagttttcatcgggcggccacatgtgtggactgttgacctcaacaatcaggaggaagtagaggatgcagtgaaagcaattttaaatcagaagattgagccatacatgccatatgaatttacgtgcgaggggatgctacagagaatcaatgctttcattgaaaaacaggacttctgccatgggcaagtgatgtggccacccctcagcgccctacaggtcaagcttgctgagcccgggcagtcctgcaagcaggtgtgccaggagagccagctcatctgcgagccttctttcttccagcacctcaacaaggacaaggacatgctgaagtacaaggtgacctgccaaagctcagagctggccaaggacatcctggtgccctcctttgaccctaagaataagcactgtgtgtttcaaggtgacctcctgctcttcagctgtgcaggcgcccaccccaggcaccagagggtctgcccctgccgggacttcatcaagggccaggtggctctctgcaaagactgcctatagcagctacctgctcagccctgcaccatgctgctggggaagacagtggccccagccccgtcaggcagggccagggacagaagtcatgcagggactctggcaagagcctgaactttttcgtagaaggttctgaattggcattgcccttgctgcactccgagcaacccagtggagtcttcaccaaaacaaaacaagagcgtatgtcaggccaggagcctggcttgtccctggcacaacatcatttctgtttctcaaggagcaactgtgggaagactgtcactgcagctgctccagggcaaaagaaagtctcaagagtcctttaaaacaaaacaggaggaattgagctgatgggaaagaactctgaatgggaatattcctaaacccattaacttatttattcgggtgggagggaggggaccgcgggagggagaggagggattgatcacaggcttcttttatttccactgttaatcatccaccttcactatactgttgttctgtctgctttgggcagggtgcaggagagagaccgtgtgccgtggggctggtggcctgctcagggacagccatggggacctggcagctcaaaacagatggcagcagaacaaaagaaacttttgctttggaagcacagccaaactccccagggcatcgtcatagatggcacctagagcatgggctgcctcagtcagggggacgtgcctgtgttgtccagagagcccagccagggacgaaaaaggagatgaggcccctttcctccatgtccccatgcccagacacataccttggccgtaatttcttttagaatccctttgggaaggaaatacaggattgagggattttggagtttctggtaaactcaccctccctccagccccgctatgaggaggaaagtagagatgaaagactcacgctgttcatggacttggagaggattatctttgagccaagatttggacaggagtgaagtcggtccttaagaatttgtggcgcgaccggagctgggctcctgacaggtgggcttgtgttgtgtcccctctgatggcaccaaagtccagggaagggggctcttgatgtctgctgggggagtgggggcagctcaggatgaatgcagtgccctgtcctggctactcacctgagggtgtagctcgcaaaggtgggaatctggtgctggcttttccttcaggcaggatcactctgacttgttgagtaatcagtcatcaggttggcctggtcagacacactggaccccaccttccaaaccctggacccccccatgctctgcctttgtataagttcccaccccactgaatcattgctgccatgctctgtacaagtttgtaagtttctgaaaagcccctgacatctccatgctgatgcaagtgagaccccttctgcctaatgtgagcggttggcgtcctccacttggcctctgctgggcgcctcagtcgctcaatgatgtgctctgtgccggggcttccaagcacccttcctgctaacagagggcggcccagtggagcctccgctgggcagaactgatgggcaaggcgtaatggctggtagctttcagaatgtgagggaaaggaagaattccgcttcatggggactagagttagtgtggggcctttaagtctgggaagttacattctgcttctttctcaattgctacacaaatgtgcagccagccttttttcttaggcccactgagatccctgctcagtgcgtctcaattgtatctccagtctaagaggagggtggggggcacccggggcctcctccactccttaggtggcccccaagcacatctgccaggtagagtaccatggggaggcctctgccctgagcatcatcacaggggcgcctccagacctggctgagaatagcctctgcttgggcctaggaagaagggcagaagtccaaaggaaaccttggtgagtgagtgtgtgtgtgtgtgtgtgtgtgtgtgtgtgtgtgtgtgtgtgtgtgtatgagcctgtgcatttcttttaagcaagggcagtttcctgcagtaggagggcagatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcggaggttttgccattgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggtttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtga

SEQ ID NO: 2337 - DNA, 1970 bp, Homo sapiens
atattggagcagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcagctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgtttt

SEQ ID NO: 2338 - DNA, 1758 bp, Homo sapiens
agaagcccagtagacaaagaaggtaagggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctcttttgcagttaaagaacatggagacttttactcttttgatggcccaggacacagtttggctcatgcctacccacctggacctgggctttatggagatattcactttgatgatgatgaaaaatggacagaagatgcatcaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggacctccccctgcctctactgaggaacccctggtgcccacaaaatctgttccttcgggatctgagatgccagccaagtgtgatcctgctttgtccttcgatgccatcagcactctgaggggagaatatctgttctttaaagacagatatttttggcgaagatcccactggaaccctgaacctgaatttcatttgatttctgcattttggccctctcttccatcatatttggatgctgcatatgaagttaacagcagggacaccgtttttatttttaaaggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcctgttcctt

SEQ ID NO: 2339 - DNA, 2291 bp, Homo sapiens
ataaggggcggcggcccggagcggcccagcaagcccagcagccccggggcggatggctccggccgcctggctccgcagcgcggccgcgcgcgccctcctgcccccgatgctgctgctgctgctccagccgccgccgctgctggcccgggctctgccgccggacgcccaccacctccatgccgagaggagggggccacagccctggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttctttttttttttttaaactgaggattgtcattaaacacagttgttttcta

SEQ ID NO: 2340 - DNA, 2716 bp, Homo sapiens
acaacagtccccaggcatcaccattcaagatgcatccaggggtcctggctgccttcctcttcttgagctggactcattgtcgggccctgccccttcccagtggtggtgatgaagatgatttgtctgaggaagacctccagtttgcagagcgctacctgagatcatactaccatcctacaaatctcgcgggaatcctgaaggagaatgcagcaagctccatgactgagaggctccgagaaatgcagtctttcttcggcttagaggtgactggcaaacttgacgataacaccttagatgtcatgaaaaagccaagatgcggggttcctgatgtgggtgaatacaatgttttccctcgaactcttaaatggtccaaaatgaatttaacctacagaattgtgaattacacccctgatatgactcattctgaagtcgaaaaggcattcaaaaaagccttcaaagtttggtccgatgtaactcctctgaattttaccagacttcacgatggcattgctgacatcatgatctcttttggaattaaggagcatggcgacttctacccatttgatgggccctctggcctgctggctcatgcttttcctcctgggccaaattatggaggagatgcccattttgatgatgatgaaacctggacaagtagttccaaaggctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtccaggagatgaagaccccaaccctaaacatccaaaaacgccagacaaatgtgacccttccttatcccttgatgccattaccagtctccgaggagaaacaatgatctttaaagacagattcttctggcgcctgcatcctcagcaggttgatgcggagctgtttttaacgaaatcattttggccagaacttcccaaccgtattgatgctgcatatgagcacccttctcatgacctcatcttcatcttcagaggtagaaaattttgggctcttaatggttatgacattctggaaggttatcccaaaaaaatatctgaactgggtcttccaaaagaagttaagaagataagtgcagctgttcactttgaggatacaggcaagactctcctgttctcaggaaaccaggtctggagatatgatgatactaaccatattatggataaagactatccgagactaatagaagaagacttcccaggaattggtgataaagtagatgctgtctatgagaaaaatggttatatctattttttcaacggacccatacagtttgaatacagcatctggagtaaccgtattgttcgcgtcatgccagcaaattccattttgtggtgttaagtgtctttttaaaaattgttatttaaatcctgaagagcatttggggtaatacttccagaagtgcggggtaggggaagaagagctatcaggagaaagcttggttctgtgaacaagcttcagtaagttatctttgaatatgtagtatctatatgactatgcgtggctggaaccacattgaagaatgttagagtaatgaaatggaggatctctaaagagcatctgattcttgttgctgtacaaaagcaatggttgatgatacttcccacaccacaaatgggacacatggtctgtcaatgagagcataatttaaaaatatatttataaggaaattttacaagggcataaagtaaatacatgcatataatgaataaatcattcttactaaaaagtataaaatagtatgaaaatggaaatttgggagagccatacataaaagaaataaaccaaaggaaaatgtctgtaataatagactgtaacttccaaataaataattttcattttgcactgaggatattcagatgtatgtgcccttcttcacacagacactaacgaaatatcaaagtcattaaagacaggagacaaaagagcagtggtaagaatagtagatgtggcctttgaattctgtttaattttcacttttggcaatgactcaaagtctgctctcatataagacaaatattcctttgcatattataaaggataaagaaggatgatgtctttttattaaaatatttcaggttcttcagaagtcacacattacaaagttaaaattgttatcaaaatagtctaaggccatggcatccctttttcataaattatttgattatttaagactaaaagttgcattttaaccctattttacctagctaattatttaattgtccagtttgtcttggatatataggctattttctaaagacttgtatagcatgaaataaaatatatcttataaagtggaagtatgtatattaaaaaagagacatccaaatttttttttaaagcagtctactagattgtgatcccttgagatatggaaggatgcctttttttctctgcatttaaaaaaatcccccagcacttcccacagtgcctattgatacttggggagggtgcttggcacttattgaatatatgatcggccatcaagggaagaactattgtgctcagagacactgttgataaaaactcaggcaaagaaaatgaaatgcatatttgcaaagtgtattaggaagtgtttatgttgtttataataaaaatatattttcaacaga

SEQ ID NO: 2341 - DNA, 1470 bp, Homo sapiens
atgcatccaggggtcctggctgccttcctcttcttgagctggactcattgtcgggccctgccccttcccagtggtggtgatgaagatgatttgtctgaggaagacctccagtttgcagagcgctacctgagatcatactaccatcctacaaatctcgcgggaatcctgaaggagaatgcagcaagctccatgactgagaggctccgagaaatgcagtctttcttcggcttagaggtgactggcaaacttgacgataacaccttagatgtcatgaaaaagccaagatgcggggttcctgatgtgggtgaatacaatgttttccctcgaactcttaaatggtccaaaatgaatttaacctacagaattgtgaattacacccctgatatgactcattctgaagtcgaaaaggcattcaaaaaagccttcaaagtttggtccgatgtaactcctctgaattttaccagacttcacgatggcattgctgacatcatgatctcttttggaattaaggagcatggcgacttctacccatttgatgggccctctggcctgctggctcatgcttttcctcctgggccaaattatggaggagatgcccattttgatgatgatgaaacctggacaagtagttccaaaggctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtccaggagatgaagaccccaaccctaaacatccaaaaacgccagacaaatgtgacccttccttatcccttgatgccattaccagtctccgaggagaaacaatgatctttaaagacagattcttctggcgcctgcatcctcagcaggttgatgcggagctgtttttaacgaaatcattttggccagaacttcccaaccgtattgatgctgcatatgagcacccttctcatgacctcatcttcatcttcagaggtagaaaattttgggctcttaatggttatgacattctggaaggttatcccaaaaaaatatctgaactgggtcttccaaaagaagttaagaagataagtgcagctgttcactttgaggatacaggcaagactctcctgttctcaggaaaccaggtctggagatatgatgatactaaccatattatggataaagactatccgagactaatagaagaagacttcccaggaattggtgataaagtagatgctgtctatgagaaaaatgagtctcactctgtcacccaggctggagttcattgtcgcaatctgagctcgctgcaacctccgcctcctgggttcaagagattctcctgcctcagcctctggagtagctgggattacaggttatatctattttttcaacggacccatacagtttga

SEQ ID NO: 2342 - DNA, 1152 bp, Homo sapiens
atgcatccaggggtcctggctgccttcctcttcttgagctggactcattgtcgggccctgccccttcccagtggtggtgatgaagatgatttgtctgaggaagacctccagtttgcagagcgctacctgagatcatactaccatcctacaaatctcgcgggaatcctgaaggagaatgcagcaagctccatgactgagaggctccgagaaatgcagtctttcttcggcttagaggtgactggcaaacttgacgataacaccttagatgtcatgaaaaagccaagatgcggggttcctgatgtgggtgaatacaatgttttccctcgaactcttaaatggtccaaaatgaatttaacctacagaattgtgaattacacccctgatatgactcattctgaagtcgaaaaggcattcaaaaaagccttcaaagtttggtccgatgtaactcctctgaattttaccagacttcacgatggcattgctgacatcatgatctcttttggaattaaggagcatggcgacttctacccatttgatgggccctctggcctgctggctcatgcttttcctcctgggccaaattatggaggagatgcccattttgatgatgatgaaacctggacaagtagttccaaaggctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtccaggagatgaagaccccaaccctaaacatccaaaaacgccagacaaatgtgacccttccttatcccttgatgccattaccagtctccgaggagaaacaatgatctttaaagacagattcttctggcgcctgcatcctcagcaggttgatgcggagctgtttttaacgaaatcattttggccagaacttcccaaccgtattgatgctgcatatgagcacccttctcatgacctcatcttcatcttcagaggtagaaaattttgggctcttaatggttatgacattctggaaggttatcccaaaaaaatatctgaactgggtcttccaaaagaagttaacaagcttcagtaa

SEQ ID NO: 2343 - DNA, 3732 bp, Homo sapiens
accagaggagagagcgagagagggaaccagaccccagttcgccgactaagcagaagaaagatcaaaaaccggaaaagaggagaagagcaaacaggcactttgaggaacaatcccctttaactccaagccgacagcggtctaggaattcaagttcagtgcctaccgaagacaaaggcgccccgagggagtggcggtgcgaccccagggcgtgggcccggccgcggagcccacactgcccggctgacccggtggtctcggaccatgtctcccgccccaagacccccccgttgtctcctgctccccctgctcacgctcggcaccgcgctcgcctccctcggctcggcccaaagcagcagcttcagccccgaagcctggctacagcaatatggctacctgcctcccggggacctacgtacccacacacagcgctcaccccagtcactctcagcggccatcgctgccatgcagaagttttacggcttgcaagtaacaggcaaagctgatgcagacaccatgaaggccatgaggcgcccccgatgtggtgttccagacaagtttggggctgagatcaaggccaatgttcgaaggaagcgctacgccatccagggtctcaaatggcaacataatgaaatcactttctgcatccagaattacacccccaaggtgggcgagtatgccacatacgaggccattcgcaaggcgttccgcgtgtgggagagtgccacaccactgcgcttccgcgaggtgccctatgcctacatccgtgagggccatgagaagcaggccgacatcatgatcttctttgccgagggcttccatggcgacagcacgcccttcgatggtgagggcggcttcctggcccatgcctacttcccaggccccaacattggaggagacacccactttgactctgccgagccttggactgtcaggaatgaggatctgaatggaaatgacatcttcctggtggctgtgcacgagctgggccatgccctggggctcgagcattccagtgacccctcggccatcatggcacccttttaccagtggatggacacggagaattttgtgctgcccgatgatgaccgccggggcatccagcaactttatgggggtgagtcagggttccccaccaagatgccccctcaacccaggactacctcccggccttctgttcctgataaacccaaaaaccccacctatgggcccaacatctgtgacgggaactttgacaccgtggccatgctccgaggggagatgtttgtcttcaaggagcgctggttctggcgggtgaggaataaccaagtgatggatggatacccaatgcccattggccagttctggcggggcctgcctgcgtccatcaacactgcctacgagaggaaggatggcaaattcgtcttcttcaaaggagacaagcattgggtgtttgatgaggcgtccctggaacctggctaccccaagcacattaaggagctgggccgagggctgcctaccgacaagattgatgctgctctcttctggatgcccaatggaaagacctacttcttccgtggaaacaagtactaccgtttcaacgaagagctcagggcagtggatagcgagtaccccaagaacatcaaagtctgggaagggatccctgagtctcccagagggtcattcatgggcagcgatgaagtcttcacttacttctacaaggggaacaaatactggaaattcaacaaccagaagctgaaggtagaaccgggctaccccaagtcagccctgagggactggatgggctgcccatcgggaggccggccggatgaggggactgaggaggagacggaggtgatcatcattgaggtggacgaggagggcggcggggcggtgagcgcggctgccgtggtgctgcccgtgctgctgctgctcctggtgctggcggtgggccttgcagtcttcttcttcagacgccatgggacccccaggcgactgctctactgccagcgttccctgctggacaaggtctgacgcccaccgccggcccgcccactcctaccacaaggactttgcctctgaaggccagtggcagcaggtggtggtgggtgggctgttcccatcgtcccgagccccctccccgcagcctccttgcttctctctgtcccctggctggcctccttcaccctgaccgcctccctccctcctgccccggcattgcatcttccctagataggtcccctgagggctgagtgggagggcggccctttccagcctctgcccctcaggggaaccctgtagctttgtgtctgtccagccccatctgaatgtgttgggggctctgcacttgaaggcaggaccctcagacctcgctggtaaaggtcaaatggggtcatctgctccttttccatcccctgacataccttaacctctgaactctgacctcaggaggctctgggcactccagccctgaaagccccaggtgtacccaattggcagcctctcactactctttctggctaaaaggaatctaatcttgttgagggtagagaccctgagacagtgtgagggggtggggactgccaagccaccctaagaccttgggaggaaaactcagagagggtcttcgttgctcagtcagtcaagttcctcggagatctgcctctgcctcacctaccccagggaacttccaaggaaggagcctgagccactggggactaagtgggcagaagaaacccttggcagccctgtgcctctcgaatgttagccttggatggggctttcacagttagaagagctgaaaccaggggtgcagctgtcaggtagggtggggccggtgggagaggcccgggtcagagccctgggggtgagcctgaaggccacagagaaagaaccttgcccaaactcaggcagctggggctgaggcccaaaggcagaacagccagagggggcaggaggggaccaaaaaggaaaatgaggacgtgcagcagcattggaaggctggggccgggcaggccaggccaagccaagcagggggccacagggtgggctgtggagctctcaggaagggccctgaggaaggcacacttgctcctgttggtccctgtccttgctgcccaggcagcgtggaggggaagggtagggcagccagagaaaggagcagagaaggcacacaaacgaggaatgaggggcttcacgagaggccacagggcctggctggccacgctgtcccggcctgctcaccatctcagtgaggggcaggagctggggctcgcttaggctgggtccacgcttccctggtgccagcacccctcaagcctgtctcaccagtggcctgccctctcgctcccccacccagcccacccattgaagtctccttgggccaccaaaggtggtggccatggtaccggggacttgggagagtgagacccagtggagggagcaagaggagagggatgtcgggggggtggggcacggggtaggggaaatggggtgaacggtgctggcagttcggctagatttctgtcttgtttgtttttttgttttgtttaatgtatatttttattataattattatatatgaattccattcaaatcgttcctttttgttaacaaggggcatggggaggggtgggggtgggggggcagaggcgtctgaccccaggaacctgcagggcggggctgggtcggtgccctctaaggacaattttgaccttgttcaacctttccacaaagaataaattgtgtttcacattc

SEQ ID NO: 2344 - DNA, 3741 bp, Homo sapiens
tggggtgacgaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaatcttattgatgaagaga

SEQ ID NO: 2345 - DNA, 3377 bp, Homo sapiens
atgcctgccctcctgggaatgaagcacagcaggtctcagcctcatcttacccagccccccactcaagatggaggtgcctggtttgaacacctctgacaaatggaagtctgtgttgtccagaggcaatgcagtgggggcttaagaagataactctggacttagaccgcttggcttcaaatcaaagagtgcatgaaccaaccagctggcctagtgatgatgttaggcaagtgacttctcagtttcttcatctgcaaactgggaaatttcctatctcagggttaaaagagaggtaatcttaggtgcttacctagcacatgcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttg

SEQ ID NO: 2346 - DNA, 1978 bp, Homo sapiens
agatgttgtcttgtgagcgtgcgcgcgcctggctggaggggcactgagcctggccgcagtgttgccaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggatcattggctacacacctgatctggacccagagacagtggatgatgcctttgctcgtgccttccaagtctggagcgatgtgaccccactgcggttttctcgaatccatgatggagaggcagacatcatgatcaactttggccgctgggagcatggcgatggatacccctttgacggtaaggacggactcctggctcatgccttcgccccaggcactggtgttgggggagactcccattttgatgacgatgagctatggaccttgggagaaggccaagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccgccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggggcctctcctgacattgaccttggcaccggccccacccccacgctgggccctgtcactcctgagatctgcaaacaggacattgtatttgatggcatcgctcagatccgtggtgagatcttcttcttcaaggaccggttcatttggcggactgtgacgccacgtgacaagcccatggggcccctgctggtggccacattctggcctgagctcccggaaaagattgatgcggtatacgaggccccacaggaggagaaggctgtgttctttgcagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggagatacaatgaggtgaagaagaaaatggatcctggcttccccaagctcatcgcagatgcctggaatgccatccccgataacctggatgccgtcgtggacctgcagggcggcggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggagggg

SEQ ID NO: 2347 - DNA, 2016 bp, Homo sapiens
aatcactgtgttgccttgcaaaattgggaaggttgagagaaattagtaaagtaggttgtatcatcctactttgaatttggaatgtttggaaatggtcctgctgccatttggatgaaagcaaggatgagtcaagctgcgggtgatccaaacaaacactgtcactctttaaaagctgcgctcccgaggttggacctacaaggaggcaggcaagacagcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatggacctggaaatgttttggcccatgcctatgcccctgggccagggattaatggagatgcccactttgatgatgatgaacaatggacaaaggatacaacagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggacctccccctgactcccctgagacccccctggtacccacggaacctgtccctccagaacctgggacgccagccaactgtgatcctgctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggctatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagttatttta

SEQ ID NO: 2348 - DNA, 1125 bp, Homo sapiens
gaaaacaccaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaattta

SEQ ID NO: 2349 - DNA, 2336 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaaccttta

SEQ ID NO: 2350 - DNA, 1262 bp, Homo sapiens
aatggccccgccccagccactaaggttcggccttttctgcccagctggccgcctcttccttggtctggtgtcccaggcaccgcccacgggtctagcctcttctcaggagtgctctacagcgccccctaggccaccaagattgtttagctccctgtcgggtcggcccctgactccttattggactcatccatctggctcatccaaggccttgggtctctccagctgactcgacggtgatggggggcaactcggcgggggagctgtgcgtcttccccttcactttcctgggtaaggagtactcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaaccttt

SEQ ID NO: 2351 - DNA, 570 bp, Homo sapiens
gatttacaaaggaatgaatctgcatgaaagtttaccaacaagatccctgcctgccttttgcaggctctcctgcaaccatctacttcatttttgatctcaggaagaccagagctgaggcttaggtggagaaaagcagggctagaattggaacccaaagcccagaatggcaggagaggatgtgggggctccacccgatcacctctgggttcaccaagagggtatctaccgcgacgaataccagcgcacgtgggtggccgtcgtggaagaggagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtcaggggagtacaggagctgttgcttaagcttttgcctgatgactaacctggtgctgggattctacgaagatatgctcctttgttctgttcagtatttggcaatcacttcatccactactgcagtgcacc

SEQ ID NO: 2352 - DNA, 2274 bp, Homo sapiens
ggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatgcttaggtggagaaaagcagggctagaattggaacccaaagcccagaatggcaggagaggatgtgggggctccacccgatcacctctgggttcaccaagagggtatctaccgcgacgaataccagcgcacgtgggtggccgtcgtggaagaggagacgagtttcctaagggcacgagtccagcaaattcaggttcccttaggtgacgcagctaggccaagtcaccttcttacctcccagctacctctcatgtggcaactctacccggaggagcgctacatggataacaactctcgcttgtggcagatacagcatcatttaatggtcaggggagtacaggagctgttgcttaagcttttgcctgatgactaacctggtgctgggattctacgaagatatgctcctttgttctgttcagtatttggcaatcacttcatccactactgcagtgcacccacccttgggcctggggggagggagtgggttgaaaaactgctcaagaaacagaagtttagcaagggtcatgaagaatactgcaagtgaaactgcagagagaggttacgtaggcagaaagcaagtcaacaaaagcacttagtcaggatccgtaacttgaaattgactcctttggaaattgccatagaacccttaatggacatcatcggctggacctgggatctgatgaatcccacaaaagtcagcaccttctacagaacagatgccctgatcaccaaggacttggtactgatttagagagaagagagcagctcctagcagcatcaacatctatttgtcgcttatttgccctgcagcaattcacctgcctttccttctcccatcctgtaaatatcctaggttttgctccagtgtttcccatcccagtactgacctaatttggatctgctgagtatttagagggctctgaaaagagatatgcattgatgaaattagctacaaaggcttgtgggcctttttttctatctgaaatcgtgtcttcaaattactggaagttgctgatcaaaattgtgggctcttgaattcattctctgattacagatattttaaataagctggtttctataagaacttcaagaaaaaccattttagctgcttaactggcacctttctcaggaagtaataacaccaaatattgctgattcctaggaaaacatttactacttgtaaagaatttcctgagttaaagtagttataacagtttatatacattaaaagtaaggttttactttaaaaaaaaaagtcttgggaataatagctaccatgtattggagtcctttccaggcactattgtatgtactttatatactttatcacatttaatcctcctgtcaatgctttgaggtaggtatgattcccattttatatatgagtaataaaaaaagctcaaggagtttaatcatttatcaagggtttcttctgcgaatgatagagccaggctgcgccgtcggctcctctagcctaacgttggtttacagtattcaaaaagagttgattgaattcaaggttttttttccatgtaaagctatttatatcttccaagcctaatgaaatggatattataaaaatacagttgattcatcctatgtttgggaagagtatttttagtgtaattattttccagcaattgtaagggcatatactgcttgtctcagaagaaaattccacgtagaggggctttaaagtctttatggaaaaaagaaaaataaaaatcatttttcttgttttag

SEQ ID NO: 2353 - DNA, 1361 bp, Homo sapiens
cgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagag

SEQ ID NO: 2354 - DNA, 7198 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagc

SEQ ID NO: 2355 - DNA, 966 bp, Homo sapiens
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 2356 - DNA, 1582 bp, Homo sapiens
gcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagag

SEQ ID NO: 2357 - DNA, 1076 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggacttattactaggagtatatcaagttactgtgtatcaggcaggggagagtgatacagattcatttgaagaagatcctgaaatttccttagctcattatttatag

SEQ ID NO: 2358 - DNA, 798 bp, Homo sapiens
atgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 2359 - DNA, 1401 bp, Homo sapiens
atgtgcaataccaacatgtctgtacctactgatggtgctgtaaccacctcacagattccagcttcggaacaagagaccctggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 2360 - DNA, 6853 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagc

SEQ ID NO: 2361 - DNA, 754 bp, Homo sapiens
ctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcctaaagaaaaggaataagccctgcccagtatgtagacaaccaattcaaatgattgtgctaacttatttcccctag

SEQ ID NO: 2362 - DNA, 891 bp, Homo sapiens
atgtgcaataccaacatgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 2363 - DNA, 732 bp, Homo sapiens
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 2364 - DNA, 1171 bp, Homo sapiens
ctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtctt

SEQ ID NO: 2365 - DNA, 657 bp, Homo sapiens
atgtgcaataccaacatgtctgtacctactgatggtgctgtaaccacctcacagattccagcttcggaacaagagaccctggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 2366 - DNA, 842 bp, Homo sapiens
tgtgttcagtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtatatcaagttactgtgtatcaggcaggggagagtgatacagattcatttgaagaagatcctgaaatttccttagctgactattgg

SEQ ID NO: 2367 - DNA, 6700 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagc

SEQ ID NO: 2368 - DNA, 7381 bp, Homo sapiens
ggggcgcgcaccgaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcaga

SEQ ID NO: 2369 - DNA, 393 bp, Homo sapiens
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 2370 - DNA, 845 bp, Homo sapiens
tgtgttcagtggcgattggagggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaa

SEQ ID NO: 2371 - DNA, 6778 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagc

SEQ ID NO: 2372 - DNA, 7228 bp, Homo sapiens
gcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagc

SEQ ID NO: 2373 - DNA, 697 bp, Homo sapiens
ggggaaactttatagtcatcttggtacgtggcgagggtttcatatgttttctgaattatgcctaattttgtagtagactggagggtttatacagatagcctgtttttaacagtagattttggcctttgtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaagg

SEQ ID NO: 2374 - DNA, 547 bp, Homo sapiens
caacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagaaatgggtcatttgttctgtagaatttcccacgctctagagttggcagattaatgtcgctttagatgaagatgctattgttttatgaagcaaacggggaaaaatccagatttcaagatcccataaccctgtatgacttaacacttgaaagttgaaattaaatgtaaaaagccata

SEQ ID NO: 2375 - DNA, 10073 bp, Homo sapiens
gggaggccggaagttgcggcttcattactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagatgctgctcagactctcgctctcgcacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagtttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctctttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctgtaatcccaacactttgggagatcacctaggtcgggagtttgagaccagcctgaccgacatggagaaaccccatttttactaaaaatacaaaaaattagctgggcatggtggtgcatgcctgtagtcccagctactcaggaggctgaggcaggagaatcgcttgaacctgagagggggagattgcggtgagctgagattgcgccattgcaccccagcctgggcaacaatagcgaaactgtctcagaaaaaagaaaaaaaaaatcgcaaaaagaaaaatctcataatgtcgttgttggtttttttttttttttttgagacagtctcactctgttgcccaggctggagtgcaatggcatgatctctgctcaccgcaacctctgcctcccgggttcaggtgattctcctgcctcagcctcccagatagctgggactacaggcacataccaccatgcctggctaatttttgtatttttagtagagatgggggtttcactgtgttggccaggctggtctcgaactcctgacctcatgatccacacacctcggcctcccaaagtcctgcgattacaggcgtgagctaccgcacccagccaagttgtaatttttaataaaacttaagaagtaaacattttacttatgtttataggtatttgatcctaaatttgacacatcattgcccatgaaagaatcctcttaggctgctcagcttcactcttcctgcttgcccaccggggtttttcactgcttctgttagcactaagtacttagacgatcctaagatatgtgcttgagccgaatttcatctttacttgtaggaaactttaaactatttcttttcttttcttttttttttttttttacttgagatggagttttgctcttgtcgcccaggctggagtgcagtggagtgatctcggctcactgcaacctctgcctcccgggttcaaatgattctcctgcctcagcctcccaagtagctgggattacaggtgtgcaccaccatgtctggctaattttgtatttttagtagagatggtttcaccatgttggtcaggctggtctcgaactcctgacctcaggtcatccacccacctcagcctcgcaaagtgctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtcagttatctgcttaaattgttcagaactatatcctaacgagcaattagttctgatggttctcccagtcatgagtgtgcatgtgtgcaagcatgttttgatcctgatgctacctttgctaaaaatggccatagattaggaactagctatgtttttagaatcaaagatgaaccggtaagctgtctcatgtaccaaacgtgaaatttacagtgtttacaaatgtctggaattttgcactgccatagggaatgttaaggttacttggctggaatttatcagacttgtgagtaaacaagttgaagtttagcagatgagggggaatattgaggcccctaaggctaaacaaaataatcagtatctgagatagtggctaatgtggctccccaggcctaatttgggaacagtttttcctgattgctttgagaagtactttcttttgacagaaattttcattctgcttgccattgctatattctccctttataggagccattggatttctttccttttgtgggaaatgtcccattagcattttcagatcttttgatgtgcactaatgccattattggtaatgccgttattggtgaatacagcatagttaaataaactgttacagtaaatctacacttggatttgctgcacctctaccaatagccttttgaatgactgaaagtgttaacagagaaagaggcatgtctgcagaaagagatagctaatattttttggtactttatctgaaatccaagatgctgcttcccctgcaggttgttttccttcttacgatcctcattgaatcccctctgggagcacaggacagttagtagaactctccatttctttttttttttttttagacggagtctctctctgtcgccccggctggagtgcagtggcgcgatctcggctcactgcaacctccgcctcccgggttcaccccattctcctgcctcagcctccctagtagctgggactataggcgcccgccaccacgcctggctaatttttgtatttttattggagacggggtttcaccgtcttagccaggatggtcttgatctcctgacctcgtgatctgcccacctcagcctcccaaagtactgggattacaggcgtgagccaccgcgcccggccggaactctccatttcttaaggtaaagagggtcaaggatacctaaaaagggtcaaataatgctagaagagcaattcctctttcagagcagttgctgtaatttggcaaatgctttatcgaagattgatattaggctaggggcggtggcttacgcctgtaatcccagcactttgggaggccgaggtgggtggattgcctgagctcaggagttcgagaccagtctgaccagtatggtgaaaccctgtctctactaaaaatacaaaaattagccggtcgtggtggcgtgcacctgtagtcccagctacttggcaggttgagacaggagaatcgcttgaacctgggaggtggaggttgcagtgagccgagactgcaccactgcgctcccacctgggtgacagagactctgtctcaaaaaaaaggacatttatcattataacatcttattagagcccctaatttcttatctgaaggcactgtttttttttttaaacagttaagtactgatgtcaacagacaaatatttctgatcagatagtcccctgtcaacagtagcaaatgtggtttcataaagtgggaagaaaacagcattttaaagtaactttttgggagactgatttgagtaataataaaactctggtctcccttaagaaaaaaaaacccttccacctttactgtgtcatttatatccccttagttccaaagttaattatcttatttctggatattgcttttataccaaagacccttatcagcccttgtaactacagtatctttagataagattcctctttccagtcagtcctgggaaatgtttctgttgcagagttaggcggtagatgggaagctgtgatggcagagctactatctaataaagtaacaactcgtagttgaggcttcctttctgtgtgtgatgggggatagggagttagctcccctgttgtctcagcactaagaaattgaggtcaggccaggcgcggtggttcactcctgttattccagcactggggtggccaaagtgggcagattgcttgcgctctggagctcgagaccagcctgggcaacatggtgaaaccctgtctctaccaaaaatacaaaaaaaaagctgggcatggtgggtgcatgcttgtcccagctactgaggaggctgaggtgggaggatcgcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtagctgggactacaggcgtgcaccaccacacctggctaattttgtatttttagtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagactgaattgagtaataataaaacttcagtctttcgctaataataataataataataataataacaacaacttattgaatgtggccagctcactagatgaggaaagaggaaggcattttctgcattcttgcctagttttccttataagcaccactaagttaatagctctgtctttttggtgtttgcactatgtaatgcttttaatactttttaattgtgcttttttatgtattaaatgtttttccttttgcca

SEQ ID NO: 2376 - DNA, 646 bp, Homo sapiens
ctcatggagctgccgtaagttttaccaacagactgcagtttcttcactaccaaaatgacatcattttccacctctgctcagtgttcaacatctgacagtgcttgcaggatctctcctggacaaatcaatcaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaa

SEQ ID NO: 2377 - DNA, 1405 bp, Homo sapiens
atgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataa

SEQ ID NO: 2378 - DNA, 513 bp, Homo sapiens
gacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaa

SEQ ID NO: 2379 - DNA, 1477 bp, Homo sapiens
agcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacagatgctgctcagactctcgctctcgcacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagag

SEQ ID NO: 2380 - DNA, 863 bp, Homo sapiens
attactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacaggatgccaaagaagagtgaatggcccacaaagagcctggtagcacatacgcttttcaaaaggtcatgcacttacagctaaagccattaagggtctcactctgtcaccaggctggagtgcagtggcacaatctaggctcactgcagcctcgacctcccaggttcaagcaatcctcccacctcagcctcccggttagctgggactatagctatgcgccaccatgtccctatgttgcccagcctcggtgtctggatgcccagcctaaccaagtcagcttcccatctttggctgagacaaggagaaccctgctgggctaggggacccagatagtgaccaggttctgcatgtgatttccctgtggaattccaaccaaggacagacag

SEQ ID NO: 2381 - DNA, 5592 bp, Homo sapiens
attactcgccatttcaaaatgctgccgaggccctaggatctgtgactgccacccctccccccacccgggctcggcgggggagcgactcatggagctgccgtaagttttaccaacagactgcagtttcttcactaccaaaatgacatcattttccacctctgctcagtgttcaacatctgacagtgcttgcaggatctctcctggacaaatcaatcaggtacgaccaaaactgccgcttttgaagattttgcatgcagcaggtgcgcaaggtgaaatgttcactgttaaagaggtcatgcactatttaggtcagtacataatggtgaagcaactttatgatcagcaggagcagcatatggtatattgtggtggagatcttttgggagaactactgggacgtcagagcttctccgtgaaagacccaagccctctctatgatatgctaagaaagaatcttgtcactttagccactgctactacaggatcacagtatggatattccaagtcaagaccaactgaagcaaagtgcagaggaaagttccacttccagaaaaagaactacagaagacgatatccccacactgcctacctcagagcataaatgcatacattctagagaagatgaagacttaattgaaaatttagcccaagatgaaacatctaggctggaccttggatttgaggagtgggatgtagctggcctgccttggtggtttttaggaaacttgagaagcaactatacacctagaagtaatggctcaactgatttacagacaaatcaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtgattgaagtgggaaaaaatgatgacctggaggactctaagtccttaagtgatgataccgatgtagaggttacctctgaggatgagtggcagtgtactgaatgcaagaaatttaactctccaagcaagaggtactgttttcgttgttgggccttgaggaaggattggtattcagattgttcaaagttaacccattctctctccacgtctgatatcactgccatacctgaaaaggaaaatgaaggaaatgatgtccctgattgtcgaagaaccatttcggctcctgtcgttagacctaaagatgcgtatataaagaaagaaaactccaaactttttgatccctgcaactcagtggaattcttggatttggctcacagttctgaaagccaagagaccatctcaagcatgggagaacagttagataacctttctgaacagagaacagatacagaaaacatggaggattgccagaatctcttgaagccatgtagcttatgtgagaaaagaccacgagacgggaacattattcatggaaggacgggccatcttgtcacttgttttcactgtgccagaagactaaagaaggctggggcttcatgccctatttgcaagaaagagattcagctggttattaaggtttttatagcataatggtagtacgaacataaaaatgcatttattccgttcacttaccacattatttgaaaatcaatcctttatttaattttatttccaacctgtcagagaatgttcttaggcatcaaaatccaaggtagctgtaagaaaaatactggagctaacaatgaagaacagaagtaatctgattagtcaaattattaagtgccatggattactttatgcagcagtcaggtacatagttaggtgaacccaaaagaaaaactcttgaaaacaagagatttcttccatgcacatttacaatattgaggtataattaacatgataaagtgtttccttctaacgagttgtagaaatctgagtaaccacccaaaaaagcaatagaatgtttctgtcaccccaaaacactcccttctgcccctcttcagacagtccttcagctatttcatggctctcaccctagttttttttttttttgcacttttttttttccgggggtataggggaggtgtggggcgacagggtctgtcttgttctgtctcccaggctgaagtgcagtgcagtggtatgatcatggctcactgcagccttggtttcctgggcataagtggtcttcccacttcagcctcctgagtagctgagactatagactagcataaccacactggctaattttttgtggagatgaagtctcactatgttgcccaggctggtctcgaactcctgggctcaaacaatcctcccgcctcagccttccaaattgctgggattatagtcatgaggcacctagtctggcccttttgcaagactttaatctgaaatctaaatttttaaaatttaagtacttacaaaggatatactatccaacatattgcatattatatatgtgctttaaagtttttttttttttttgagagacggtctcactttgtcatccaagctggagtgcagtggtgcaaacacggcccacctcctgggctcaagtgatcctccagcctcagcttccctcacaggcattcactatcactcccagctaattaaaataatttgtagacggtgtctcgttatgttgcccaggctggtctcgaactcctgggtttaagtgattcccccgcctcagcctcccaaagtgttgggcttacagccttgagccactatgcttggctcaaagatatttttatgaaagccctgggactatagatttagctgattaaatttatagaaaaagtcctgtcatataaactggcaaagtctgttcttaatttaattagccaaatcagacttaacttccgtcagaacatgtcttggttttaattcagataaacacacaaacatacttctctggcacagccttcagaagcatcagtttttgttttgttttgttttgttttttgagacagggtcttgctctgtcgcccaggctggagtgcactggcacaatcacagttcactgcagcctcgacctcccagatccaagcaatcctcccacctaagcctcccaagtagctgggtctataggcgcgtgccaccaccatgcccagctgaattttgtattttttgtacagacagcattttgccatgttgcccaggctggtcccaaacttctagcctcaagcaaccctcctgcctcagcctctcaaagtgctaggattgcagtcctgagctactgccccctaccctctttgcgtcttaggagtcatttagattttttttgatccttttgtttagtgcctctggagctgcttacaccaaggcaatacgccttgatatactggatggttgagaggcagcctctttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctggtctcgaactcctgacctcatgatccacacacctcggcctcccaaagtcctgcgattacaggcgtgagctaccgcacccagccaagttgtaatttttaataaaacttaagaagtaaacattttacttatgtttataggtatttgatcctaaatttgacacatcattgcccatgaaagaatcctcttaggctgctcagcttcactcttcctgcttgcccaccggggtttttcactgcttctgttagcactaagtacttagacgatcctaagatatgtgcttgagccgaatttcatctttacttgtaggaaactttaaactatttcttttcttttcttttttttttttttttacttgagatggagttttgctcttgtcgcccaggctggagtgcagtggagtgatctcggctcactgcaacctctgcctcccgggttcaaatgattctcctgcctcagcctcccaagtagctgggattacaggtgtgcaccaccatgtctggctaattttgtatttttagtagagatggtttcaccatgttggtcaggctggtctcgaactcctgacctcaggtcatccacccacctcagcctcgcaaagtgctgagattacaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgtt

SEQ ID NO: 2382 - DNA, 8677 bp, Homo sapiens
ggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggatgccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaacgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcgatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 2383 - DNA, 4017 bp, Homo sapiens
ctttctctgtcaggctcctatgctcttcatgtcttcctttgtccactatctggtgacctgtcaaaactttgctcccttgaaatattgtgatgactgctgcttgcccccacttctgcttgccatttctgctctcccctaaatgtacactttatacccagtgcagctctgctttctgggtgaaagtgccagccctgtgcctgctccaggcgtgctttgctggcctcgctctcactcctcgcctgcatgtatcccctgcacggtcacattcatgggcttgtttcccgtgaaccaatctgcacatctctggccttattcttcccccttgccaagtagtccccaccgctgccttcttgtttccctccttgcccttctgcagctctcttccagacctaccccaaatccctcttcttgacaaagctttccaaatgcctgtccttgctactcccattgtgccttgcagagtacctaggtcttcaggtttgtgcgtgagctcccctaggaggccgggagatcccttgaggcaagagctctctcctgctcctcttgctgtgcccttctcgcagtgcactcatagtacgttatatagttagtgctccacaaagtgagtggatcatgttgaatttagtaaaacagccatttctgagtgtctccttgaagtgtttgctttatggacacacagaacaggcaggagcagctgttcctcagcatcgaccttgcgctcctctgagccctgctgttggtcacagctccagtgtctgtccttgcctttctccccaaccaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 2384 - DNA, 694 bp, Homo sapiens
cctggaacagtacttaaacaagggagcgtgctgtgtgttccagtaaaactggacttgcagaagtggaggtggaggggctggattggctgagggctatcgtttgccaactcctagcttacagtatcacgtacttattgattttttcatccgttatctctgttgatccctccctgatctgtcttctgtttctcaaagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcga

SEQ ID NO: 2385 - DNA, 5308 bp, Homo sapiens
gctcccggcttagaggacagcggggaaggcgggcggtggggcagggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggatgccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaacgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcgatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggcaattgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatga

SEQ ID NO: 2386 - DNA, 7576 bp, Homo sapiens
ttggatttaagaaaatgacctcaaaatgtccgtcagagacgtattcccaggaagaaagatattacttctactacaaaccaaatcaaaaggaaatgaaattccaatgcaacaggagtgaactgccacgcctacgggctgttctccaaactgcagcctccagccacgactgcaacgcgcaacccactttcatttctcatgagtcagcggacaccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagaaggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctta

SEQ ID NO: 2387 - DNA, 582 bp, Homo sapiens
gtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttc

SEQ ID NO: 2388 - DNA, 582 bp, Homo sapiens
attaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaaatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgct

SEQ ID NO: 2389 - DNA, 916 bp, Homo sapiens
acatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtcccc

SEQ ID NO: 2390 - DNA, 583 bp, Homo sapiens
aatactcatccttacctggcgccccgctccgagtttaggtatgaagacacagggagacgtcgggccacaagggaacccactgaggtggggaccaaagatggtggctctttgaattggagccaagcgtggtgggcacccgctgagttggcctgtcataaagacggagttgacactttatccatggggcatcctactttccctacctgtcaacagtttccctctagagtggcatattttcagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcacc

SEQ ID NO: 2391 - DNA, 6506 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagaaggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 2392 - DNA, 850 bp, Homo sapiens
gaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctacca

SEQ ID NO: 2393 - DNA, 3751 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagaaggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgtt

SEQ ID NO: 2394 - DNA, 1172 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccacacagaggaggcctcctcagctgccagaagaggtgccactgtagaggc

SEQ ID NO: 2395 - DNA, 6575 bp, Homo sapiens
caccatgtctaggaggaccgaggaaaggcgctctggccttaccagacacgtcggacgtctatgacacagcccctctatccgttgccggcagctggcgccagactctctggtcgcggtttggaactgcgcgggaagtgggtggtgggcgggcaagcggtagtgggttgtcccttggagctgcccaatcgacgtgcattattctgttggcgcacggcggccttcaattaccgtctcattaactgatctcagcagcctgggagacaccacctatttgaactctaagggggcggggctttgggtgtgcctccgctcgactggctgcggttgtgaaagacagcggcagaagccaatcagcaaataagctctttttcggcacacgcagtcgctccacccgggtcgcgaccgttactggtggcgcgcgcggggacttaaagtagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatggtactcaaatcctgagacctcctaaggttttgagccctggggtgagtcaccgtctgagggaccaggaattgattctctttgctgacttgctctgccagtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagaaggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagcagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgcctt

SEQ ID NO: 2396 - DNA, 5648 bp, Homo sapiens
ccacggctccccgggagccatcttggttcccccagaaggcgggaggggcgtaccttgggtgcgactgggcggaggtgacttggaagttcgcttctcggactgtaatactcatccttacctggcgccccgctccgagtttagatcatggaggacacccaggctattgactgggatgttgaagaagaggaggagacagagcaatccagtgaatccttgaggtgtaacgtggagccagtagggcggctacatatctttagtggtgcccatggaccagaaaaagatttcccactacacctcgggaagaatgtggtaggccgaatgcctgactgctctgtggccctgccctttccatctatctccaaacaacatgcagagattgaaatcttagcctgggacaaggcacctatcctccgagactgtgggagccttaatgtaccatcgcctggatgtctctctgccctttgtctcccggggccctctgacagtagaagagacacccagagtacagggagaaactcaaccccagaggcttctgttggctgaggactcggaggaggaagtagattttctttctgaaaggcgtatggtaaaaaaatcaaggaccacatcttcctctgtgatagttccagagagtgatgaagaggggcattccccggtcctgggcggccttgggccgccttttgccttcaatttgaacagtgacacagatgtggaagaaggtcagcaaccagccacagaggaggcctcctcagctgccagaagaggtgccactgtagaggcaaagcagtctgaagctgaagttgtaactgaaatccagcttgaaaaggatcagcctttagtgaaggagaaggacaatgatacaaaagtcaagaggggtgcagggaatggggtggttccagctggggtgattctggagaggagccaacctcctggagaggacagtgacacagatgtggatgatgacagcaggcctcctggaaggccagctgaggtccatttggaaagggctcagccttttggcttcatcgacagcgacactgatgcggaagaagagaggatcccagcaaccccagttgtcattcctatgaagaagaggaagatcttccatggagtaggtacaaggggtcctggagcaccaggcctggcccatctgcaggagagccaggctggtagtgatacagatgtggaagaaggcaaggccccacaggctgtccctctggagaaaagccaagcttccatggttatcaacagcgatacagatgacgaggaagaagtctcagcagcgctgactttggcacatctgaaagagagccagcctgctatatggaacagagatgcagaagaggacatgccccaacgtgtggtccttctgcagcgaagccaaaccaccactgagagagacagtgacacagacgtggaggaggaagagctcccagtggaaaatagagaagctgtcctcaaggatcacacaaagattagagcccttgttagagcacattcagaaaaggaccaacctccttttggggacagtgatgacagtgtggaagcagataagagctcacctgggatccacctggagagaagccaagcctccaccacagtggacatcaacacacaagtggagaaggaagtcccgccagggtcagccattatacatataaagaagcatcaggtgtctgtggaggggacaaatcaaacagatgtgaaagcagttgggggaccagcaaagctgcttgtggtatctctagaggaagcctggcctctgcatggggactgtgaaacagatgcagaggagggcacctccctaacagcctcagtagttgcagatgtaagaaagagccagcttccagcagaaggggatgctggggcagagtgggctgcagctgttcttaagcaggagagagctcatgaggtgggggcccagggtgggccacctgtggcacaagtggagcaggacctccctatctcaagagagaacctcacagatctggtggtggacacagacactctaggggaatccacccagccacagagagagggagcccaggtccccacaggaagggagagagaacaacatgtgggtgggaccaaggactctgaagacaactatggtgattctgaagatctggacctacaagctacccagtgctttctggagaatcagggcctggaagtccagagcatggaggatgaacctacccaggccttcatgttgactccaccccaagagcttggcccttcccattgcagcttccagacaacaggcctcctgaattgcaagatgccacctgctgagaaggcttccaggatcagagctgctgagaaggtttccaggggcgatcaggaatctccagatgcttgtctgcctcctacagtacctgaagccccagccccaccccaaaagccccttaactctcagagccagaaacatcttgcacctccgccccttctttctccccttttaccttctatcaagccaaccgttcgtaagaccaggcaagatgggagtcaggaagctccagaggctcccttgtcctcagagctggagcctttccacccaaagcctaaaattagaactcggaagtcctccagaatgacaccctttccagctacctctgctgcccctgagccccacccttccacctccacagcccagccagtcactcccaagcccacatctcaggccactaggagcaggacaaataggtcctctgtcaagacccctgaaccagttgtccccacagcccctgagctccagccttccacctccacagaccagcctgtcacctctgagcccacatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggatgtcgtgactccaaaaccaggcaagagaaagagagaccaggcagaggaggagcccaacagaataccaagccgcagcctccgacggaccaaacttaaccaagaatcaacagcccccaaagtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcagtcccgcaaggctggtttcttcttacccccggatgaatatgtggtgaccgaccctgagcaagagaagaactttggctttagccttcaagacgcactgagcagggctcgggagcgaaggctgctagagggctatgagatctatgtgacccctggagtccagccaccaccacctcagatgggagagattattagctgctgtggaggcacatacctacccagcatgcctcggtcctataagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatt

SEQ ID NO: 2397 - DNA, 3311 bp, Homo sapiens
ctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctacccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagatacgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccaga

SEQ ID NO: 2398 - DNA, 3487 bp, Homo sapiens
ttgaaaatattttcatgagaatttaaactgacaaaaaatctagaagtttcttcttgcctgagaccccccctcccagaaataatctctgctatcagggtgtgttctttcaagcctatttctatgtatttgctcatatatagaaatatttctagaatgatataggcttctgtgttttattatctaaatcagtcattcttaaccaggggtgattttgtaccccctcctcctaggagatacttggcaatgtctggagatatttttggttgtcacacatagagggggtgctactgccatctagtaggtagagagaccaaggatgttgctaacatcctatagggcacaggacagcccccacaataaagaatcaacgtggcctaaaacatcagtagtgctggctgggctcacgcctgtaatcccagcacttttggaggccaaggtgggcggatcacctgaggtcgggagttcaagaccagcctgtccaacacggagaaaccccatctctactgaaaatacaaaagtagccgggcgtggtggcgcatgtctgtaatcccagctactcaggaggctgaggcaggagaatcacttgaagccgggagggaggtggaggttgcggtgagccgagattgtaccactgcactccagcctgggcaacaagagtgaaactctgtctgaaaaaaaaaaaaaaaaaattatcagtagtgctgagaaaccctggtctaagtggtggtgtatggtatacattgttagacaatttcttttatacaatgtttctgggtcagtctatttagatcaactgatcgttttgcttactgccaagttttccatactacgcatagcaggtagtcgagttcaccattccccatttagtggacatctagacggctgctcgtttttatcattgcagcattctttgcacacatccttggatatgagcagacatgaaaatgtttttctagggttgacactgagcagtaaaagtgctgggttgaagggtttccagcttgcatttgtacctggccttctacaggggacagggggctatttagatggtcccctgccaaccccagtggacaaccctagggtggggctggaggtggggctgaggctgagtcttcctccccttcctccctgcccaggggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacaggtaagccaggcctggcaagagaacagggctgtgccagggcatcctttctgccctgtccctccccagagagccctgtccagaaaggtgagtagcagccccatcttgtcggccctggactggctgggccaacgatggtgacgaagtggcctggggcagggagtgacgaggagtgtctttgtggcgcagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctacccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgagg

SEQ ID NO: 2399 - DNA, 141 bp, Homo sapiens
ggcgtggtcatcgtggctgtgattgtgtgcatcctggtcctggcggtgctgggcgctgtcctctatttcctctataagaagggcaagctgccgtgcaggcgctcagggaagcaggagatggagagaaatacatcgatctga

SEQ ID NO: 2400 - DNA, 2360 bp, Homo sapiens
tgggggctgggaatttgccattctgctgtacagacactgatttttttttcttctttttaaaaagcaagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggc

SEQ ID NO: 2401 - DNA, 5622 bp, Homo sapiens
gagagcgccgagacgcgcggggcgcggagatgtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgc

SEQ ID NO: 2402 - DNA, 3590 bp, Homo sapiens
agagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaa

SEQ ID NO: 2403 - DNA, 593 bp, Homo sapiens
aacaaaaaacaaaaggttgtgactgagacctgtcaaattcatttggctctatatactttgcattcagcaacaaaattttgacttctcaacagcaaaaatattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttac

SEQ ID NO: 2404 - DNA, 892 bp, Homo sapiens
tcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaagagcaaaagacttcctttaagaatttacagggcatttacaagagggggagatggaggaagactttgcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaac

SEQ ID NO: 2405 - DNA, 856 bp, Homo sapiens
agcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaat

SEQ ID NO: 2406 - DNA, 667 bp, Homo sapiens
gtagagcagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaag

SEQ ID NO: 2407 - DNA, 2854 bp, Homo sapiens
acattcctactgagtatgacgaatggttgttgatggttatcactggagattgaaaactgggattcctttttcaccaggaattggtgcctaccatggctggggatacacagtgatggatttgtgacttgctcctctgaaagctggcccaagggtgtacagcatatgaatgtgggggagtttacactacacacgctcttggctattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccaga

SEQ ID NO: 2408 - DNA, 2556 bp, Homo sapiens
gcggctgccgggaggtgcgctgagcagggtccgcagctaaggtccagcgcgatccgagcgcccaggaccctgcggccgtggaggaggcgtgccctgggaaggagccgctactgggacctgaagaattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaaggg

SEQ ID NO: 2409 - DNA, 324 bp, Homo sapiens
gaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaaggattttaggtgatgggcaagtcagaaagtcagatggatataactgatatcaacactc

SEQ ID NO: 2410 - DNA, 3331 bp, Homo sapiens
gtctatcagcgatttcatcttcaggcctggactacaccactcaccctcccagtgtgcttgagaaacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgca

SEQ ID NO: 2411 - DNA, 3372 bp, Homo sapiens
tcagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgca

SEQ ID NO: 2412 - DNA, 495 bp, Homo sapiens
aaagtaattggagcgaagcccaaggtagcagaagctactgatttcctgtcacctgatgtctatcagcgatttcatcttcaggcctggactacaccactcaccctcccagtgtgcttgagaaacaaactgcacccactgaactccgcagctagcatccaaatcagcccttgagatttgaggccttggagactcagatcctgaacaagagagaacaaaatctctactttgatggaacttccattctgtggggaagagactgacaataagcaattaaataaataagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcag

SEQ ID NO: 2413 - DNA, 2560 bp, Homo sapiens
actcaccctcccagtgtgcttgagaaacaaactgcacccactgaactccgcagctagcatccaaatcagcccttgagatttgaggccttggagactcaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaa

SEQ ID NO: 2414 - DNA, 558 bp, Homo sapiens
cactcaccctcccagtgtgcttgagaaacaaactgcacccactgaactccgcagctagcatccaaatcagcccttgagatttgaggccttggagactcagagagaccacaagaggagcaagcaagagagctgggactaactctgtctgctacatattgccagaaattgggagactgaaggtgcaaagaagaaataatttcttggaagggctaacagcttggttggactgagatgggctgaaaagcacagagggaagggaaatcctgaacaagagagaacaaaatctctactttgatggaacttccattctgtggggaagagactgacaataagcaattaaataaataagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaatt

SEQ ID NO: 2415 - DNA, 3475 bp, Homo sapiens
actcaccctcccagtgtgcttgagaaacaaactgcacccactgaactccgcagctagcatccaaatcagcccttgagatttgaggccttggagactcagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcctggcagcaacggagaaaaactccaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgcactcattga

SEQ ID NO: 2416 - DNA, 2635 bp, Homo sapiens
agcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaagttctgtggtttttctcttattacagtgttttacttgaacacattttaaataccattttgattacaacatttactgttaatatccaagtctattatttcttctcataaaatgttcccctttttcctaatgtcttgttaatactagtccagacaagtggatatatttcctttgaccaagttatggcaagaaaaacctgacccatgataatgtcattccctcaatactaaggactcaatgcctgttttaagcagtggaaaatgaggcaaaccttgatcaaggtgttatagttcccagctgtgagccacactcaggataaaacaaaacccagcattaacctgctttagtgacacattcaaagaagttaataaaatttaatacttaaatgatacctttcacctccaatgtaagctcattttatgatgaatcctttggagactggagaaggtacattttaagtacagttccctatgtataaattgtatactgatacagtttttttgttgaaacttcaaaggcttttattaccagggttttgcttaaagagtttagatatgaataggatgatattgcagcatctcaaccttgtatgagtctgttacatagagcattggatatgggatatagtttcttaaggaaattaagggatttcctatcaaatctctattacaacagatgttagttttatgggtagaaacttaggtgaaacaagacttgtggttacattaggatggactatccatctgtaacaactccatcttattttactaagcagttattaattaattttagcaatacatcttcatctttattgtacttctatctttgttaaatgagaaaaccaaggcatcaaataattgagtagacaaagatcatattcacaagttagtaaaaagccagaattagaatgcaggttttttttttcaaagtccagttccatctacattctaccagactgcatatcctattcctgtatctattaggtattcccgaactgaggattagtgtttttaagtacagtctataaatctgttcaaagaatagttagaacattgaatgtagagttaaggctttgcagcagccaattgcaaaaataaggaatccagtcttttgaaaagaaacactactgcttgttctcataccttttataaatgtattttaaaaagaatgaactaattaataaaacatatcaaaggcttttaaggcttgttttgagcctgccttattgtggaaattgcatgcacctggtttggcaaataaattccaaaaccttta

SEQ ID NO: 2417 - DNA, 1220 bp, Homo sapiens
ggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatatt

SEQ ID NO: 2418 - DNA, 680 bp, Homo sapiens
actcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaaaggatttgacacgataagcctcatctgatggaagagaggaataaataattcacctatatgtgtttgaggttgtgacagacttataaaatctttttaaaaaataaagctataatttatattaa

SEQ ID NO: 2419 - DNA, 7556 bp, Homo sapiens
gcgcggaggcagggaaccggagccttggagcgacccaacccctcgtctcgctgccctcccgcgcctgcaacggtgcgcggagactccggcgaactcagacacccaacggcggagaacagaagcggcaggcggcggacgtggccgcgaagctgcgcgccgaacgcagcgcacccgctgccgagcagaggagccgcgcctttccccgaccctcggctccagcccccggcgcctgccgcctcgcagcccctctgcgtcctcggctcgggggccggcaccggcgatgccgagcggagcctccagtcctccgacccgctgaagaagcagcagccgctcgcccggagcctacggggattgtgcgagcggatcgtgctcggtggaggctcgggctgcggggcgcggggactccggggggcggggggagggaccgctctgtcggtgcccggcgccagccgcggctttgaagggtctccctcccctgcccttagcagctctgccacggactccgggaggctgcgggcggcgtcctgagggctccccagcagacccaatcggacttgagaaggtgatcgctctgctctcccaacccccttccctccccattccccccacttaactttttgtctccgttcatccgcggcttcgtcccctccccgcagacccacccgcggctgtgacaaccgcccggggcatgggccccccaacacggctcctagaggccccgcggcctcgcaagatgtgagaggccctccccgggcagaatcggagcttcaggagaggagctaataccccgccccccgtccctcacatcaggcggggtggaggtgcgcgctgagcccccgcggtgctgagcgtcccggagcgcccaatcctgggctggaacgagtagctggccggaggcgcgccgcggagagccggctgtcatgccctattgatccccctctgccccccgccaagtatgtttgggctggaccaattcgagccccaggtcaacagcaggaacgctggccagggcgagaggaactttaacgagaccggactgagcatgaacacccactttaaggccccggctttccacactggggggccccctggccctgtggatcctgctatgagcgcgctgggcgaacccccgatcttgggcatgaacatggagccctacggcttccacgcgcgcggccactcggagttgcacgcaggggggctgcaagcgcagcctgtgcacggcttctttggcggccagcagcctcaccacggccacccgggaagtcatcatccccaccagcatcacccccactttgggggcaacttcggtggcccggaccccggggcctcgtgcctgcacgggggtcgcctgctcggctacggcggcgcagccggaggcctgggcagccagccgcccttcgccgagggctatgagcacatggcggagagccaggggcctgagagcttcggcccgcagcgaccggggaacctcccggacttccacagttcaggtgcctccagccacgccgtgccggccccatgcctgccgctggaccagagccctaaccgagccgcctccttccacggcctgccgtcctccagcggctccgattcccacagtctggagccacggagggtgacgaaccaaggagccgtcgactcgctggaatacaattacccgggcgaggcgccctcgggacattttgacatgttttcgccctctgactccgaagggcagctgcctcattatgcagcgggtcgccaggttcctgggggcgctttcccgggcgcctcggccatgcccagagctgcgggcatggtgggcttgtccaaaatgcacgcccagccaccgcagcagcagccccagcagcagcagcagccccagcagcagcagcagcagcatggtgtgttctttgagaggttcagtggggccagaaagatgcctgtgggtctggagccctcagtgggctccaggcacccgttaatgcagcctccccagcaggccccgccaccccctcagcagcagcccccgcagcagccgccacagcagcagccgccgccgccacccgggcttctagtccgacaaaattcgtgcccgcctgcgctccctcggccccagcagggcgaggcgggcacgcccagcggcggcctgcaggacggaggccccatgctgcccagccagcacgcgcaattcgagtatcccatccaccggctggagaaccggagcatgcacccttattccgagcctgttttcagcatgcagcatcctcctccgcagcaggcgcccaaccagcggctgcagcatttcgacgcgcccccctacatgaacgtggccaagaggccgcgcttcgactttccgggcagcgcgggagtggaccgctgcgcttcgtggaacggcagcatgcacaacggcgctctggataatcacctctccccttccgcctacccaggcctacccggcgagttcacaccgcctgtgcccgacagcttcccttcggggccgcccctgcagcatccggccccggaccaccagtccctgcaacagcagcagcagcagcagcagcagcagcaacagcagcagcagcagcagcaacagcaacagcaacagcagcagcagcagcagcgccaaaacgcggccctcatgattaagcagatggcgtcgcggaatcagcagcagcggctgcgccagcccaacctggctcagctaggccaccccggggacgtgggccagggcggcctggtgcatggcggcccggtgggcggcttggcccagccgaactttgagcgcgaaggcggcagcacgggcgccgggcgtctgggcaccttcgagcagcaggcgccgcacttggcgcaagagagcgcgtggttctcaggtccgcatccgccgcccggagacctgctgccccgtaggatgggcggctcgggtctgcccgctgactgtggcccgcacgaccccagcctggcgccccctcctccgcctggtggctcgggggtgctgttccggggccctctgcaggagccgatgaggatgcccggagagggccacgtgcccgcgctgccttcaccgggcctgcagttcgggggcagtctgggaggcctgggtcagctgcagtcgcccggggcgggcgtggggctccccagcgctgcttcggagcgccggcccccgccgccggactttgctacgtctgcgctcgggggccagccgggctttccgtttggtgcagccggccggcagtccacgccgcacagcggtccaggcgtgaactcgccccccagcgcgggagggggcggtggcagctctggtggcggcggtggcgggggtgcctacccgccgcagcctgatttccagcccagccagcgcacctcggccagtaaattgggcgcgctctcgctgggctccttcaacaagcccagctccaaggacaacctgttcggccagagctgcctggctgcgctctccaccgcttgccagaacatgatcgccagcctcggggcccccaacctcaacgtgaccttcaacaagaagaacccgccagagggcaagaggaaactgagccagaacgagaccgacggcgcggcagtggccggcaacccgggctcggattacttcccaggagggactgctcctggggccccaggacccggaggcccgtccgggaccagtagcagcggctccaaagcctcggggccgcccaaccctccagcccagggggacggcaccagcctctcccccaactacaccctggaatccacgtcggggaatgacggcaagccggtctccgggggcggcggccggggacggggtcgcagaaaaagggacagtggtcacgtgagccctggcaccttctttgacaagtactcggcggctccggacagcgggggcgcacctggggtgagcccagggcagcagcaagcgtcaggcgcagccgtcgggggaagctccgcaggcgagacgcgcggggcaccgacgccccacgaaaaggcgctcacgtcgccatcctgggggaagggggctgagttgctcctgggggatcagccggacctcattgggtccctggacggcggggccaagtcggacagtagttcgccaaacgtgggtgagttcgcctcggacgaggtgagcacgagctacgccaatgaggacgaggtgtcgtccagctctgacaacccccaggcactagttaaagcgagcaggagtcccctggtgaccggctcgcccaaactccctccccgtggggtaggcgccggggaacacggaccgaaggcgcccccgcccgccctcggcctgggcatcatgtctaactctacctcgacccctgacagctacggcggcggtgggggcccgggccatccgggcactccgggcctggagcaggtccgcaccccgacgagcagcagcggcgccccgccacccgacgagatccaccccctggagatccttcaggcgcagatccagctacagaggcagcagttcagcatctccgaggaccagcctctggggctgaagggtggcaagaagggtgagtgcgccgtcggggcctcaggggcgcagaatggcgacagcgagctgggcagctgctgctccgaggcggtcaagagcgccatgagcaccattgacctggactcgctgatggcagagcacagcgctgcctggtacatgcccgctgacaaggccctggtggacagcgcggacgacgacaagacgttggcgccctgggagaaggccaaaccccagaaccccaacagcaaagaagcccacgacctccctgcaaacaaggcctcagcatcccagcctggcagccacttgcagtgcctgtctgtccactgcacagacgacgtgggtgacgccaaggctcgagcctccgtgcccacctggcggtccctgcattctgacatctccaacagatttgggacattcgtggctgccctaacttgaatgacaagaaagatcccctcctctaccaggcccttcctctccccctgtctgtttccttccccctcaaccttaccccacccctctgttaatttgaaagggccactattgctgagtggatgagttttttttttttctctaggttggtacctgcttagtggcatatggaccggaaagggttaatttaaagggggggaacctcaaaagtttttttaaaaaagaaacttgtctgccacagtatgttaccagtgttaacccttctgcagttagcaaacttttgcttaagcctttttcctctagatactccccatgtttcggtaatcttggcatacattttttagatgacctctttccttgttttgttttcatgctgctgtatgtccaagtattgttatttcataataagacaagagttgctttcttttttattctttttccttttcttaccccctccccttttattttctttttgctttgttcactgcttattaaaatggaaatcctggagaatagtagttctggaatattgccgggtgaaagtccaattgtcatcacaatgttatatattgacaccccagtgtcatcagtcaggcaggagccaaacaatgaatgcccctcttaggtattccgcctgggattttgttttgtctgttccctaagaaaatatattttcattcctgcaaacacagtgctcagccttcagttcccttccacttgagttctctcttctcctgctggaagccgcccctctctgcgatggacgtgaggacgtgtccagctctgctctgtgggaaggagttggaatgttcgacagcagtgttttctctccttttctgggcctcctcgcaaatgcccaggccctgcattttcacgctgtgctaagcagcctttggtctgcatgggggatggtgtgctcccagcctgcagtctttggagcaaggctgctgcccgtgccttgggtgctggagttggaggaggctgttctcagccctttcccttttctgaaagctgttcctggccgggcatcccagggaagaaggaggggactgcgtgtatctcctccacctctcccattccatccccagtccagcctgggcaaccccacccctgggagggatgaggcaccctcttgctcagcctgctcagccttctctgagcctttgcagggatctgcagactcctgagggctagaggacagagaaagagaatagaatgaaatgactttgattcctgcgccttttagttttgaactctggaattcctctgccccctccccaacatttttttggaatctcaccctgttgcaaaactagagccatgtcccaagcatctcacaaaggaataactgctctgagcagagatgagtggtggttggcaggggcaggcaactttgggtgctgctgatgcctgcaaaagccatttatggcttgtggtggggggcacatagattccccggtgggttagacaggaagtaactgatatcacttcacccaaatatataaccgtgatggttatctatttaatttcagtttttgttaacgagcgtgtcttactaaaacgctccactttgagctcccccaccccctccaggtcctcagagtttgcagatctgggctttctaaagcaagtgacctgaaggctctgggctcaccatacaacacccacgttgtttatttcaaagaacttttcagcgaagggagaggagctttcagaaaaacctcactctttcccctcccttctcccctctttccttctgccggtccttttggctggggtctgagtctgcggttctcgcctgggcagtcttgacgaggagcaaaccccgccttcagagggcagacaaagcaggtggcatgaattgatcagcgagaaaggtgtgagccgaggcagttcctgcgttctgctacaaaaggaatggaaagggaagggaatttccccccaccatgggctgtgggagagttgaccgtattctgggcaagactccatgacccctctgattctgcagtgtacagctgtttgagagcctcatcattttacttttgaaacaggaatgatttctccttaattgcttaaggccggggagcaaagtgtcttaacttctgtctttgactttcccagcgttgagtcatcaacactttgccaattagctcatggtcctggcaacctcagaaacccctgaagttttaaaaactttctcgctccccacgaccccagaatgaaacagctttaaaaatagccttaagcaaaaggatgttatttcattaaatttggtttaatggaaagaataaaagtaaatgaaaaacacaccctacacactagactccgaacactggtaatcagtactgcatagcaaactctttgggaaagaaaacgaaaatgttattgcacatgtaaaatatgaaaacttaactctgctgtgtgttaggcaatcctgtaatcttttttgactcttaaaagaaattcatttctgaaatgcttggttggaagactgtgacaatagctcatgaaattgagtgttatttttttctttcttttttaaaaaaatatgtaaagtgcagtcttctgtattcctgcatattgtatatacctgtatatgttttcctgagcagttaaataacaataaatatgacgttaatggtga

SEQ ID NO: 2420 - DNA, 4632 bp, Homo sapiens
gccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcag

SEQ ID NO: 2421 - DNA, 6635 bp, Homo sapiens
aggtgacccggaggccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgta

SEQ ID NO: 2422 - DNA, 2295 bp, Homo sapiens
atgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattaggcatgtcaacatcgctctaattcagagataa

SEQ ID NO: 2423 - DNA, 1460 bp, Homo sapiens
gcttatatccttgggtgaaatgtgttgcatctacatatatatttacaaacacacctacgtacctatagtgggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatg

SEQ ID NO: 2424 - DNA, 6177 bp, Homo sapiens
ggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggcccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattttgttttaagagatggcagctggccgggtgcagtggctcacgtctgtaatcccagcactttgggaggccgaggcaggtggatcacgaggtcaggagttcaagaccagcctggccaagagggtgaaaccccatctttactaaaaatacaaaaaaaaaaattagctgggtgtggtggtgggctcctgtaatcccagctactcaggaggctaaggcagagaatcatttgaacccaggagacggagtttgcaaagccaagatcgtgccactgcactccagcctgggcaacagaaggagactccgtctcaaaaaaaaaaaaaagatggcagctatataaatgataaaattaattacattctctttcacatgcatgaggtgcaaactctgtcacaaagtattttaattaccttttaccttgtttcatagatctttatgtgacataaaaacagtttctggcacggtggctcacgcctgtaatcctagcactttgggaggctgaggcaggtggatcacctgaggtcaggagtttgagaccagcctggccaatatggtgaaaccccatctctacaaaatttgcaaaaagtagatgggtgtggtagtgggcgcctgtaatcccagctactcaggaggttgaggcagagaatcgcttgaacccggggggtggaggttgcagtgagctgagatcgcaccactgcactccagcatgaaagagcgagactcaatctcaaaaaaaaaaaagtttctggcacctgaacaggaactggtttccatcatcaactcagaaagcactaaaatctaggtggtgattcagggaggagcaggggaagacagcctcctatggtggcatgaataagatgcttccagaactagtagggaaataactaacctcttcaggctttatcaggcctggaggggaaccttgctcatgttagcaagaaaggtatcctagagaagccactcaaaaggctccctaatccagcctgtctccacatacatactgaaaattcttccctactctgaggcagggtgtagtggtttaggggtttctccagactggaatcctacctatctgtaccgacaattgagcaaacaacagttgagagagtccaaaaaaaaaagtattaaaatgtgattgatgtaatttaccatgtttactttatgcatgcattttattggggaggggaggtcagaataattcacccaaatctagtggtcttatttcataggctaatctggtttatatttgcattaaagatactggagggcaatatttacagagtttagtttttcttaattaaaaacagtcctctattaatatagtgtgaaatatctttcaaaatttagagtttaggtttaagatgtctactagatatctttaagattttcctgtaaactcactgcacaaactggaattactttccaaaagacttagggaatgcaaatatgttactcataagatgcattgagtattgtaaataaaacaaaccatttttgatttgtttaaattgctcgttacagttctcttgtggggagggactttgtcagtcattttgcatcttaagctagactaaactttttgttgttgttttcctaaaaccataggtgcaagctttgccgctgggaagtcatattgaattaagcacttttgaaaatgtcactgtttgtgacacacaatgttctctacagaaaacttcttctatcttatgtcattttagcagtagatgtagctgcctgccaccaggtgcaatatgtcatttgcatcagccttttcagttaaggaaattaaaacttggcatgcattagttcatatgtatgaggttggctgtgtccccaaacagcaattgcttgtacaagatagaagtttgcttctcagctgggcatggtggctcatgcctgtaatccaagctctttgggaggccaacgcgggaggattgtttgagcccaggagtttgaaaccatcctgagcaatagagagacccccatctcgacaaaaaaaaaaaaa

SEQ ID NO: 2425 - DNA, 2876 bp, Homo sapiens
tcctcctcttcctctcccgcccgcgccgcggccctcccgtccctgcgcggcctcggcggcctcggcggcggcggcggcggcggcggcggcagcagcgcggcccctttaaacgcctgcggcgccccccgcccccgccatcgcgcctccattttcccggccgcccgcgccgagcgccgcgcccgccccgggcccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaacccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacaggccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaa

SEQ ID NO: 2426 - DNA, 2844 bp, Homo sapiens
gctcctcctcttcctctcccgcccgcgccgcggccctcccgtccctgcgcggcctcggcggcctcggcggcggcggcggcggcggcggcggcagcagcgcggcccctttaaacgcctgcggcgccccccgcccccgccatcgcgcctccattttcccggccgcccgcgccgagcgccgcgcccgccccgggcccctccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaacccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggcacgtcctcaggtctggcaaaccacggacaggccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatatt

SEQ ID NO: 2427 - DNA, 1673 bp, Homo sapiens
cgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacaccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggcacttacctgggtctggcaaaccacggacaggccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatatt

SEQ ID NO: 2428 - DNA, 2144 bp, Homo sapiens
ccgccgccgccggcccggacatggccgccaacatgtacagggtcggagactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaacccggaaatggtggacctgcccgagaaactaaagcaccagctgcggcatcgggagctgttcctctcccggcagctggagtctctgcccgccacgcacatcaggggcaagtgcagcgtcaccctgctcaacgagaccgagtcgctcaagtcctacctggagcgggaggatttcttcttctattctctagtctacgacccacagcagaagaccctgctggcagataaaggagagattcgagtaggaaaccggtaccaggcagacatcaccgacttgttaaaagaaggcgaggaggatggccgagaccagtccaggttggagacccaggtgtgggaggcgcacaacccactcacagacaagcagatcgaccagttcctggtggtggcccgctctgtgggcaccttcgcacgggccctggactgcagcagctccgtccgacagcccagcctgcacatgagcgccgcagctgcctcccgagacatcaccctgttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttctcccgtggaagtcgctgaccagcatcattgagtactactacatgtggaagaccaccgacagatacgtgcagcagaaacgcttgaaagcagctgaagctgagagcaagttaaagcaagtttatattcccaactataacaagccaaatccgaaccaaatcagcgtcaacaacgtcaaggccggtgtggtgaacggcacgggggcgccgggccagagccctggggctggccgggcctgcgagagctgttacatgtcgtctctgcgcatcttgttggacatattggaagaaatatggtggcttgaaaatgccaacccggttagatggagagaggccaggaccaaaccgcagtaacatgagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgcacggcgcggctgcccgaagcctcccagagcccgctggtgctgaagcaggcggtacgcaagccgctggaagccgtgcttcggtatcttgagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggcaacatgaagaagcgcctcttgatgcccagtaggggtctggcaaaccacggacaggccaggcacatgggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgc

SEQ ID NO: 2429 - DNA, 4758 bp, Homo sapiens
ccccgggagcccagccagagcgagcgccggggccgggcgcgcaggagtgaaaaggaggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagatt

SEQ ID NO: 2430 - DNA, 4458 bp, Homo sapiens
cccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagaactcgtccagctcggcctcctccgaagcctcggaaacctgccagtcagtgagcgagtgcagctcccccacctctgtcagctcgggctccaccatgggtgcctgggtgtccacagagaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagatt

SEQ ID NO: 2431 - DNA, 1822 bp, Homo sapiens
ctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagaactcgtccagctcggcctcctccgaagcctcggaaacctgccagtcagtgagcgagtgcagctcccccacctctgtcagctcgggctccaccatgggtgcctgggtgtccacagagaagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatctttta

SEQ ID NO: 2432 - DNA, 4944 bp, Homo sapiens
gcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggggagctatccagtttgggaagatttcataaacaaagcaggaaagctgcagtcccagcttcggacaacagtagtagcagcagctgccttcttggacgcctttcagaaagtggctgacatggccaccaacacacgtggtgggaccagggagattggatctgctctcaccaggatgtgcatgaggcacagaagcattgaagccaagctgaggcagttttcgagcgctttaattgattgtctgataaacccacttcaagaacagatggaagaatggaagaaagtggccaaccagctggataaagaccacgcaaaagaatataagaaagcccgccaagagataaaaaagaagtcctcggatacgctgaaactgcagaagaaagcaaaaaaagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgaagaagaaatctcaatgctaggggaaataacccaccttcagaccatctcggaagatctaaaaagcctgaccatggaccctcacaaactgccctcctcaagtgaacaggtgattctggacttgaaaggttctgattacagctggtcgtatcagacgccaccctcttcccccagcaccaccatgtccagaaagtccagtgtctgcagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccaggcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagatt

SEQ ID NO: 2433 - DNA, 3601 bp, Homo sapiens
gcagtcgggtctggccccagtcgactccagccaggcggggctccaagccgagactcctgcacgcccggcccgaagctagcccgacaccctcagctgagtcctccgccgtcccagcattccctgcgtccctaccatcgagagcagcttccggcgtggctggtgtaggcgggtggagaaggatcggggccctcgccgctctgtctcattccctcgcgctctctcgggcaacatggcgggtgtggaggaggtagcggcctccgggagccacctgaatggcgacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatggagatggagcaactggaaagaagaagaaaaagaagaagaagaagagaggaccaaaagttcaaacagaccctccctcagttccaatatgtgacctgtatcctaatggtgtatttcccaaaggacaagaatgcgaatacccacccacacaagatgggcgaacagctgcttggagaactacaagtgaagaaaagaaagcattagatcaggcaagtgaagagatttggaatgattttcgagaagctgcagaagcacatcgacaagttagaaaatacgtaatgagctggatcaagcctgggatgacaatgatagaaatctgtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaggattattgactgtgcttttactgtcacttttaatcccaaatatgatacgttattaaaagctgtaaaagatgctactaacactggaataaagtgtgctggaattgatgttcgtctgtgtgatgttggtgaggccatccaagaagttatggagtcctatgaagttgaaatagatgggaagacatatcaagtgaaaccaatccgtaatctaaatggacattcaattgggcaatatagaatacatgctggaaaaacagtgccgattgtgaaaggaggggaggcaacaagaatggaggaaggagaagtatatgcaattgaaacctttggtagtacaggaaaaggtgttgttcatgatgatatggaatgttcacattacatgaaaaattttgatgttggacatgtgccaataaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctgagagctacatctcaatgtctgtggttataattctggacaggataaatagctaaacttaatgtaggcaaatgcagagacatttatctgaaatgtagacctctacactgagacttttctggcatagtggctaaaacaagatctacacatgcataaaaagggacaatcaccttttcttcataaatatacagctttaggaatatttcaccattctttgtaggacatagtagtccttgtctttttttctcctgacattggaaagatgtgctaattgaaacttgacttagtaggaacattgtgccaactcaaaaccttgatttagtaaaaatctcaatgtttagatcctttgtccagtggtggtgtttatcagggaatgtattcagcttgctcagaaaaccaaaagggtattaaagccacaaaagcaaagaagaaaaaaaaaaacttcccatgtttggatcttgttctagttagaaaaattaagttgaaattcttggactttttcattcatgaggcaaatgctgtaataccttcccctttgacaggtttggattcttaacattactagtggtatttcaggaagtgacgttacagttactttccttatagcggctaagtgtattaagttgaatgtaacgatggtaatattaatttgtttgaactgaggcccactactgattctttgacaaattgaattcttatatttaaataattttatgggaatgttccatcataatttctaaatcatttatatatcaaggtagccttaatttgtatatgtttcagtacaatgagattttattgcctctgggatgctgtttagtttgtattttgttgaacgtttttatcctaggaagagaaacctatgacttgtgtacctagatcatctgttacattaaaaagctgctctttcagcattagagctataaatgaatgttaccttgtcgggaaacaatctaggttttagctgtatgagctatgtttattatggtgctaatgttcagtagccacatttgactaatgtctccattctctgtgatgctgtggctagcagcagagctcgccagttcatgcctggacatactgtcagggctgggccctccagctagctcctttggggttgagtccgtatctttttgatgtggaagtataaagcaagtatcttgatttctaaacccagcaattttagaattgacctttatgagtgaagacttttggagcttttaaagaccttggcagtcatgatctcaaaccaattaggagctccaagctcccttcccaggtaactgttgggagcaatggcatcactgtatgcccttgtaatggctggaagggacatgatcttgtaagtaggaaagctgtaactaaaaattgtattgtttgcttattagccatgtatctcttaaaattttgttatgtttacaacgatgtaccttattggcaacaagttattagtttgatgtttaacaatagtgcctttagtaaattattttacaactaaaa

SEQ ID NO: 2434 - DNA, 2470 bp, Homo sapiens
ggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggtgagaaaatatttcaagaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttctaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaagac

SEQ ID NO: 2435 - DNA, 804 bp, Homo sapiens
atgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttca

SEQ ID NO: 2436 - DNA, 2478 bp, Homo sapiens
gattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccgcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactgaagataccatcccacgaacacagatagaaagaaggaaaacaagcctgtatttttccagcaaatataacaaagaagctcttagccccccacgacgtaaagcctttaagaaatggacacctcctcggtcaccttttaatctcgttcaagaaacactttttcatgatccatggaagcttctcatcgctactatatttctcaatcggacctcaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcagatgaatacctgacaaagcagtggaagtatccaattgagcttcatgggattggtaaatatggcaacgactcttaccgaattttttgtgtcaatgagtggaagcaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttctaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaagacaaataa

SEQ ID NO: 2437 - DNA, 1135 bp, Homo sapiens
ctccaaataaccaccctcctcttcaggacacctcaaagatgtccaacgccagctgaaaaggggggtaaaaatgcaggttccatttgacagtgtgacgtatctgaaatcagaaaggacttgtcaactctgggaacacaactcaagttttcccaggatgctttgcagggggaagctggactgtcagtgacccagaaagggtgagggatagagtgagaaaggactggagaagctaaaacagcagcatgataagcacaaagtcctgtgaggaagctcattctgaaaacgcttgtttcattccaaactcttttcagatggaaataaaaggaaacatgggtgggatttactggagctggcctggattctccctcagattccaggaggggttatgagaaaagaccccagacttaggcacgtgaagcagggtagacgcttcgagagccctggctgcggtccccaggccccacccgctgccacctgcgggcccagattggcccggccccacccccggcaacgcctctctcagtcccttagcaaccgccccctccccaggccgactccgccggcttcttaccagctcctcgggggtgcgggtctcacgctcaccgcagcagcagcaccacctgcagcagcagcacagagaccccctgcaccccgccatcttcctcctttactgccactctggacccctctaccaaccccctcccagccaggatctgcgcctcacgtgactggccccgggacggtcacgtggccctctcgagctctgggactgagaccaggagtggctgcagacgggtggggcgaggactcgcgtcacatgacgataaaggcacggcctccaacgagacctgtgggcacggccatgttgggggcggggcttccggtcacccgcgccggtggtttccgccctgtaggcccgcctctccagcaacctgacacctgcgccgcgccccttcactgcgttccccgcccctgcagcggccacagtggtgcggccggcggccgagcgttctgagtcacccgggactggaggtaggaacccagccatggtgaacgaagccagaggaaacagcagcctcaacccctgcttggagggcagtgccagcagtggcagtgagagctccaaagatagttc

SEQ ID NO: 2438 - DNA, 7021 bp, Homo sapiens
atggaccatcgaaaagccagggtcctcccagctgggcactactgcccctcgctaggaatatgggcctcgcaggtcggcagcgtgaggtcctctgtgccaccttccatcagtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagcgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagaaagtgtctttgaagtcttcgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacacttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagcagcccagcttcctggtgtatttttcaggtaggcccttgtcctgccagctgccttcctcatcccctcgtcctgtcccagaggttatctgcctggcctggctccccacgagtcacctgcaagccccagggcctgggggcagtgactggcaggtgcagatgggctgtttcgtgtagtggaagagcagcctgatggccaagggggtggacgcaattgtgggatgtcctctttactcccttcctggcctcactggctggggcagaggggcagccgctaggagagactgaaagcagcagctaggactgaggagtgggttttattgtccttcagagctcttcaagctgtcccctctgtcatcactccctggatgtgtggggcatggttccttccctgggaaggctaagttcagttctgttttttattctatgagaacaagtcacagctgcagctgggccccatgctctgccccaagcccccaaccccgcggtgctctggcggcttcctgtccactctcggggcccttggggcctggcttgctccagggtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctagtgtgagtggcagccatgcctcatgccacaccttcttcgcaaactgatggaccgggtgggcctggcctgagctggggccacaaatcaaagcaagggctccagcatccagcctgtgtgttctgtaatggaactgaccccctcccctgaaaacgaaggggccccggggctggcaagcagggaaagctccacggtgcgtggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccccgcagcccgtgaagcagtgcctcgaggcaccggcgctgcaggtacttcctcctgatggccaagagcatcgtgacccttcagggccagaaggagggcagagccatgggcctgggcctgcttttccaggatcctgcaggaacgagcactggccagagagggcccagctgtagccatggctcaggcaagcccctcagcccttgcccccatccctcggacccaccaaactgcacacacagctcctcttaccgtagcctccgtttatgggccttgctttgggctttgcaggctctgggctcagggctggagtgcgctcttggtccctggtccctcgtccacaggggcaggcctgggacccagctactctgtccaggccactgtggccagagctggaaggcagggcagagggaatgttccctgcaccctggaaaggggagttgagtcacaagaggttaaggtgggtccaggaaggcagctgctcttagtgcccgcctaggagttgagtacagtgaggagggtggaggaaggtgctgagcttagccttgtgccctgcccccatctccccaggcctccagcctctcccggctgcctgccgcccaaagagaaatcacaggggcggggcaggaatgcaaagtgttttctcagaacagctgaaacattccgaagagggaatggatggggagaatggtcaatacacataagaccgtgtcccaaggagctgatttccaggcccctgaggactggagaccgcttcacccctgcacttcagacaccgtttgtcccccggggcaaggtctccttactctgagcccaggccgttccccttggcttcctccgtccacccaggctgcactgcagtgatggcgcgggaggcaccagctctgtggcctgtgtccagcagctgcgggtctgaaggaatagccagagaggagcacctgaaccccatgggcttggacttcctggggccccgctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaacgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctc

SEQ ID NO: 2439 - DNA, 5532 bp, Homo sapiens
gtccgccgggacctttctgggagtcgtaggcttaatgaccctatgccctctgttggcctgtctgtgccctggtggctctgattacttgtttctgttttttgtttttgtttttttttttgagatggagttttgcttttgtcgcccaggctggagtgctatggcacaatcttggttcactgcaacctctgccttccgggttcaagcgattctcctgcctcagcctccagagtagctgggattacaggcgcccgccaccaaacctggctaatttttatatttttagtagagtcgggatttcaccatgttggccaggctggtctcaaactcctggcctcaggtgatccacccacctcggcctcccaaagtgctgggattacaggtgtgttttttgtttttttaagagatggagtctcgctatgttgcccaggctggccttgaactcctgggctcaggcaatccttctgcctcagccttcccagtagctgggtcactgtgatgatttgaattgaattctgtgatgtgtaagaagagcagcctgcaaggcaagcacagatggggcagcttttgttctgagaaattcgtgcccttactgaacttgggtctggctatttttggaacatggccagcatcaagttctaacccacaacacggtctttttggagtagcatgaattcaggagaaatctggctgcatagtcaagccctcaccccttccatcctgtgcacgaactgtttcaagtaacagatgttccaggcagagccagccagagtgagctgttccttctctggagggtgatctggtatccctgaacgcctgttggcctcatctccaccaacccctgcagtctctgcccctgagtccccctccttccatccgcctccccttactagagcctcagccctccctcctcgcctggaagccttgcccccgcccccttgtgctggctggagctcaagcctcttcctttgtcgcagctccgcccagttgaacacacccgctggggaaggtgcctctgttccctccccacgcactctgggcctgagctgacagagatggaccatcgaaaagccagggtcctcccagctgggcactactgcccctcgctaggaatatgggcctcgcaggtcggcagcgtgaggtcctctgtgccaccttccatcagtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagcgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagaaagtgtctttgaagtcttcgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacacttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagcagcccagcttcctggtgtatttttcaggtaggcccttgtcctgccagctgccttcctcatcccctcgtcctgtcccagaggttatctgcctggcctggctccccacgagtcacctgcaagccccagggcctgggggcagtgactggcaggtgcagatgggctgtttcgtgtagtggaagagcagcctgatggccaagggggtggacgcaattgtgggatgtcctctttactcccttcctggcctcactggctggggcagaggggcagccgctaggagagactgaaagcagcagctaggactgaggagtgggttttattgtccttcagagctcttcaagctgtcccctctgtcatcactccctggatgtgtggggcatggttccttccctgggaaggctaagttcagttctgttttttattctatgagaacaagtcacagctgcagctgggccccatgctctgccccaagcccccaaccccgcggtgctctggcggcttcctgtccactctcggggcccttggggcctggcttgctccagggtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctagtgtgagtggcagccatgcctcatgccacaccttcttcgcaaactgatggaccgggtgggcctggcctgagctggggccacaaatcaaagcaagggctccagcatccagcctgtgtgttctgtaatggaactgaccccctcccctgaaaacgaaggggccccggggctggcaagcagggaaagctccacggtgcgtggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccc

SEQ ID NO: 2440 - DNA, 6232 bp, Homo sapiens
atgttgggggcggggcttccggtcacccgcgccggtggtttccgccctgtaggcccgcctctccagcaacctgacacctgcgccgcgccccttcactgcgttccccgcccctgcagcggccacagtggtgcggccggcggccgagcgttctgagtcacccgggactggaggtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagcgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagaaagtgtctttgaagtcttcgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacacttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagcagcccagcttcctggtgtatttttcaggtaggcccttgtcctgccagctgccttcctcatcccctcgtcctgtcccagaggttatctgcctggcctggctccccacgagtcacctgcaagccccagggcctgggggcagtgactggcaggtgcagatgggctgtttcgtgtagtggaagagcagcctgatggccaagggggtggacgcaattgtgggatgtcctctttactcccttcctggcctcactggctggggcagaggggcagccgctaggagagactgaaagcagcagctaggactgaggagtgggttttattgtccttcagagctcttcaagctgtcccctctgtcatcactccctggatgtgtggggcatggttccttccctgggaaggctaagttcagttctgttttttattctatgagaacaagtcacagctgcagctgggccccatgctctgccccaagcccccaaccccgcggtgctctggcggcttcctgtccactctcggggcccttggggcctggcttgctccagggtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctagtgtgagtggcagccatgcctcatgccacaccttcttcgcaaactgatggaccgggtgggcctggcctgagctggggccacaaatcaaagcaagggctccagcatccagcctgtgtgttctgtaatggaactgaccccctcccctgaaaacgaaggggccccggggctggcaagcagggaaagctccacggtgcgtggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccccgcagcccgtgaagcagtgcctcgaggcaccggcgctgcaggtacttcctcctgatggccaagagcatcgtgacccttcagggccagaaggagggcagagccatgggcctgggcctgcttttccaggatcctgcaggaacgagcactggccagagagggcccagctgtagccatggctcaggcaagcccctcagcccttgcccccatccctcggacccaccaaactgcacacacagctcctcttaccgtagcctccgtttatgggccttgctttgggctttgcaggctctgggctcagggctggagtgcgctcttggtccctggtccctcgtccacaggggcaggcctgggacccagctactctgtccaggccactgtggccagagctggaaggcagggcagagggaatgttccctgcaccctggaaaggggagttgagtcacaagaggttaaggtgggtccaggaaggcagctgctcttagtgcccgcctaggagttgagtacagtgaggagggtggaggaaggtgctgagcttagccttgtgccctgcccccatctccccaggcctccagcctctcccggctgcctgccgcccaaagagaaatcacaggggcggggcaggaatgcaaagtgttttctcagaacagctgaaacattccgaagagggaatggatggggagaatggtcaatacacataagaccgtgtcccaaggagctgatttccaggcccctgaggactggagaccgcttcacccctgcacttcagacaccgtttgtcccccggggcaaggtctccttactctgagcccaggccgttccccttggcttcctccgtccacccaggctgcactgcagtgatggcgcgggaggcaccagctctgtggcctgtgtccagcagctgcgggtctgaaggaatagccagagaggagcacctgaaccccatgggcttggacttcctggggccccgctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaaaaaaaaaa

SEQ ID NO: 2441 - DNA, 7057 bp, Homo sapiens
gccttcttcctgtgtggaaatacagcgcctccggcttgaacctgccactcaggtgtcttgatgtgtcgggggtgtggctgcctgccccctgatgctccctgccccaccctgtgcagtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagcgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagaaagtgtctttgaagtcttcgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacacttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagcagcccagcttcctggtgtatttttcaggtaggcccttgtcctgccagctgccttcctcatcccctcgtcctgtcccagaggttatctgcctggcctggctccccacgagtcacctgcaagccccagggcctgggggcagtgactggcaggtgcagatgggctgtttcgtgtagtggaagagcagcctgatggccaagggggtggacgcaattgtgggatgtcctctttactcccttcctggcctcactggctggggcagaggggcagccgctaggagagactgaaagcagcagctaggactgaggagtgggttttattgtccttcagagctcttcaagctgtcccctctgtcatcactccctggatgtgtggggcatggttccttccctgggaaggctaagttcagttctgttttttattctatgagaacaagtcacagctgcagctgggccccatgctctgccccaagcccccaaccccgcggtgctctggcggcttcctgtccactctcggggcccttggggcctggcttgctccagggtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctagtgtgagtggcagccatgcctcatgccacaccttcttcgcaaactgatggaccgggtgggcctggcctgagctggggccacaaatcaaagcaagggctccagcatccagcctgtgtgttctgtaatggaactgaccccctcccctgaaaacgaaggggccccggggctggcaagcagggaaagctccacggtgcgtggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccccgcagcccgtgaagcagtgcctcgaggcaccggcgctgcaggtacttcctcctgatggccaagagcatcgtgacccttcagggccagaaggagggcagagccatgggcctgggcctgcttttccaggatcctgcaggaacgagcactggccagagagggcccagctgtagccatggctcaggcaagcccctcagcccttgcccccatccctcggacccaccaaactgcacacacagctcctcttaccgtagcctccgtttatgggccttgctttgggctttgcaggctctgggctcagggctggagtgcgctcttggtccctggtccctcgtccacaggggcaggcctgggacccagctactctgtccaggccactgtggccagagctggaaggcagggcagagggaatgttccctgcaccctggaaaggggagttgagtcacaagaggttaaggtgggtccaggaaggcagctgctcttagtgcccgcctaggagttgagtacagtgaggagggtggaggaaggtgctgagcttagccttgtgccctgcccccatctccccaggcctccagcctctcccggctgcctgccgcccaaagagaaatcacaggggcggggcaggaatgcaaagtgttttctcagaacagctgaaacattccgaagagggaatggatggggagaatggtcaatacacataagaccgtgtcccaaggagctgatttccaggcccctgaggactggagaccgcttcacccctgcacttcagacaccgtttgtcccccggggcaaggtctccttactctgagcccaggccgttccccttggcttcctccgtccacccaggctgcactgcagtgatggcgcgggaggcaccagctctgtggcctgtgtccagcagctgcgggtctgaaggaatagccagagaggagcacctgaaccccatgggcttggacttcctggggccccgctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaacgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgacaaaaaaa

SEQ ID NO: 2442 - DNA, 398 bp, Homo sapiens
ctcagtgaatgttggctatcaccgtgtgccaaactctggggataccccaggcaggacaccggtcctgtctcagggaactggggaaagagaaaggagacaggccttttcacccacagttacaacccagggtgctatgggagtccagctgataacggataaatcgtgggagttggcttacaaatatggcacatgcgtggcatatactaggaatgcaataagtctttgaaaatcagagggtttacaggtggttcagcttcctcctactctaggttctgttccagcaagcaattaacgagtaggaacccagccatggtgaacgaagccagaggaaacagcagcctcaacccctgcttggagggcagtgccagcagtggcagtgagagctccaaagatagttc

SEQ ID NO: 2443 - DNA, 1034 bp, Homo sapiens
cagtggtgcggccggcggccgagcgttctgagtcacccgggactggagggtgagtgacggcgaggccggggtcgccgggagggagatcctggagccggcaaacaacctcccgggggcaaggacgtgcttgtgggcggggagcgctggaggccggcctgcctctcttcttggggggggctgccgcctcccttgcgcacccttcgcgggattagtgtaactcccaatggctaccacttccagcgaccgccaaccctcaagcgaagactgactttggctccctgcctggacggaggggcccctgagccaggggtgacgatcccgcccctctgaccggcccaggcccgtgtcctcgcccccatcggtgactcagtgacctggtgactggattctcggccacctgggcgccgagacggcttccggctcctgccttttaaacctgcctccccggcgatcacctggagaagagcgctgggcccggggcactgcggtccctggcgcccactgcgtcccgctgcgcacgggggtccgccgggacctttctgggagtcgtaggcttagtatcccagtgcttggcgcagactagttgttcataggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaa

SEQ ID NO: 2444 - DNA, 1539 bp, Homo sapiens
gtccgccgggacctttctgggagtcgtaggcttaatgaccctatgccctctgttggcctgtctgtgccctggtggctctgattacttgtttctgttttttgtttttgtttttttttttgagatggagttttgcttttgtcgcccaggctggagtgctatggcacaatcttggttcactgcaacctctgccttccgggttcaagcgattctcctgcctcagcctccagagtagctgggattacaggcgcccgccaccaaacctggctaatttttatatttttagtagagtcgggatttcaccatgttggccaggctggtctcaaactcctggcctcaggtgatccacccacctcggcctcccaaagtgctgggattacaggtgtgttttttgtttttttaagagatggagtctcgctatgttgcccaggctggccttgaactcctgggctcaggcaatccttctgcctcagccttcccagtagctgggtcactgtgatgatttgaattgaattctgtgatgtgtaagaagagcagcctgcaaggcaagcacagatggggcagcttttgttctgagaaattcgtgcccttactgaacttgggtctggctatttttggaacatggccagcatcaagttctaacccacaacacggtctttttggagtagcatgaattcaggagaaatctggctgcatagtcaagccctcaccccttccatcctgtgcacgaactgtttcaagtaacagatgttccaggcagagccagccagagtgagctgttccttctctggagggtgatctggtatccctgaacgcctgttggcctcatctccaccaacccctgcagtctctgcccctgagtccccctccttccatccgcctccccttactagagcctcagccctccctcctcgcctggaagccttgcccccgcccccttgtgctggctggagctcaagcctcttcctttgtcgcagctccgcccagttgaacacacccgctggggaaggtgcctctgttccctccccacgcactctgggcctgagctgacagagatggaccatcgaaaagccagggtcctcccagctgggcactactgcccctcgctaggaatatgggcctcgcaggtcggcagcgtgaggtcctctgtgccaccttccatcaggtagctgtcaccgaggagcatgttgcagtgccgggtgggggctgccttgcatgcaaggagcctggcagcagcggagggcaaggctttgagtgaggcggcccggacagccatagctgaggagcatggagccactgggagggggcagtgtcaccttttttggccttcttcctgtgtggaaatacagcgcctccggcttgaacctgccactcaggtgtcttgatgtgtcgggggtgtggctgcctgccccctgatgctccctgccccaccctgtgcagtaggaacccagccatggtgaacgaagccagaggaaacagcagcctcaacccctgcttggagggcagtgccagcagtggcagtgagagctccaaagatagttc

SEQ ID NO: 2445 - DNA, 870 bp, Homo sapiens
gtccgccgggacctttctgggagtcgtaggcttaatgaccctatgccctctgttggcctgtctgtgccctggtggctctgattacttgtttctgttttttgtttttgtttttttttttgagatggagttttgcttttgtcgcccaggctggagtgctatggcacaatcttggttcactgcaacctctgccttccgggttcaagcgattctcctgcctcagcctccagagtagctgggattacaggcgcccgccaccaaacctggctaatttttatatttttagtagagtcgggatttcaccatgttggccaggctggtctcaaactcctggcctcaggtgatccacccacctcggcctcccaaagtgctgggattacaggtgtgttttttgtttttttaagagatggagtctcgctatgttgcccaggctggccttgaactcctgggctcaggcaatccttctgcctcagccttcccagtagctgggtcactgtgatgatttgaattgaattctgtgatgtgtaagaagagcagcctgcaaggcaagcacagatggggcagcttttgttctgagaaattcgtgcccttactgaacttgggtctggctatttttggaacatggccagcatcaagttctaacccacaacacggtctttttggagtagcatgaattcaggagaaatctggctgcatagtcaagccctcaccccttccatcctgtgcacgaactgtttcaagtaacagatgttccaggcagagccagccagataggaacccagccatggtgaacgaagccagaggaaacagcagcctcaacccctgcttggagggcagtgccagcagtggcagtgagagctccaaagatagttc

SEQ ID NO: 2446 - DNA, 3158 bp, Homo sapiens
gcatgcccagtgcccgcgcgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggtggaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtaggcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctgaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaagacaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtgttaaaaatagaccaacaaggcatgatgttttagatgactcatgtgacggctttaaggacctcatcaaacctcatgaggaattgaagaaaagtgggagaggcaaaaagccaacaagaacattagtcatgacaagcatgccatctgaaaagcagaatgtcgtcatccaggttgtggataaattgaaaggcttttcaattgcaccagacgtctgtgagaccacgactcacgtgctttccgggaagccacttcgcaccctgaatgtgctgctgggaattgcgcgtggctgctgggttctctcttatgattgggtgctatggtctttagaattgggtcactggatttctgaggagccgttcgaactgtctcaccacttccctgcagctcccctgtgccgaagcgagtgccacttgtctgcagggccgtaccgcggaaccctctttgccgaccagccagcgatgtttgtctcgcctgccagcagccccccagtggccaagctctgtgaactagtccacctgtgcggaggccgggtcagccaagtcccccgccaggccagcatcgtcatcgggccctacagcggaaagaagaaagccacagtcaagtatctgtctgagaaatgggtcttagattccatcacccagcacaaggtctgtgcccctgaaaactacctattgtcacaatgacagtgacctcactggcctgtggtgactgcacacagctcgcaaaactgtctttggatgttcaaatgagaaacaaaactgtgaagagaaggaactggcgtatacaagatgacttctgatatcatgtttgccatgtgttgtggttcttaagaactcataggtgactttctgatgactgaatgtctgtttcagagacgcttcgggcctttttatttttattttattttttattttttgagacggagtcctgccctgtttcccaggctggagtgcaatggcacaatctcggctcactgcaacctccacctcccaggttcaagcgattctgctgcctcagcctcctgagtagctgggattacagatgtgtgccaccatgcctggctaatttttgtagttttagtagagacagggtttcgccatgttggccaggctggtctcaaacgcctgagctcaggtgatctgtcaggcctcttctatagaattccagtctttgtgtcttagtcatgatcataattgaaaggtcacagaacctttgtcattagagcacagtactgccaaataaagaatggaaattcaa

SEQ ID NO: 2447 - DNA, 2917 bp, Homo sapiens
gcccagtgcccgcgcgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggtggaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtaggcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctgaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaagacaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtatgtgaatctccttttccaagtcaccttcgctaaataaacatgtaacagtgcatccatattttaaatttatcacaactttttcataacttatttccccatttactcctctttttacttaaagaatgtgcatttgatcattccaatgataaactctttaggaatagatgacttgctgtcttgtggaacttctagacttattggttaagtctgttaggaatctatttctccaagacttttccttcttataggtcaaaaggataagtagtccatagtatgaataactgaggggagtgaagtctttttccttattccattggagtcttggcgctgcagcgtgtgtaaagatgtatacgatagagagttttttaaaacctaggttcttaatagtgaggctatttaaagaaagaaattaaggtagattaagccatcgattgtatcatagagaaagtgtgaaaaactacttttagaaatctgttgtcaatattgatttttgaagaaactttggtcagtgttaactatgaagaaacatttaaacatttttgatcatttgtaacaagccttgtttaacttgtacttattttgcttgaagcatcacttgaaaaggtttactcctattcataatttaattgtaattataataaaccatatcattttattaaaagtcaaaacaataaaaaattttgcacttcacagttataagcacaaataggttccagcaaccaaaattgaagaaatcttgaactttgaccgtctttacctaaagattaggttaaaatttgagtgagaacgcattctctctgcatgatttctctgctctacaaatgttttaactgcctctttgaaggtggagaagtcatggtagcgtttgaaatcatcacagacatgttacataccttttccttgagtatacgctccccaaaattgtttcacaaaaagaatgaaaataattttatgtttttggcctgctatttatatcttggctttctgaacatatattaaatttgacaagaaactgta

SEQ ID NO: 2448 - DNA, 2049 bp, Homo sapiens
agctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggtggaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctgaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaagacaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtatgtgaatctccttttccaagtcaccttcgctaaataaacatgtaacagtgcatccatattttaaatttatcacaactttttcataacttatttccccatttactcctctttttacttaaagaatgtgcatttgatcattccaatgataaactctttaggaatagatgacttgctgtcttgtggaacttctagacttattggttaagtctgttaggaatctatttctccaagacttttccttcttataggtcaaaaggataagtagtccatagtatgaataactgaggggagtgaagtctttttccttattccattggagtcttggcgctgcagcgtgtgt

SEQ ID NO: 2449 - DNA, 382 bp, Homo sapiens
gtacctgtctataaggagtcctgcttatcacaatgaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaagatttttgagcaaaca

SEQ ID NO: 2450 - DNA, 549 bp, Homo sapiens
tcgaatgcgtggttgccctctccagtataaaagtttgatgcagctttgcctggatgtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagccatgcctatcagtaaaaagatttttgagcaaacacttgaa

SEQ ID NO: 2451 - DNA, 6160 bp, Homo sapiens
gtggcgcctcgctactttctgcagcttgtttgcactttttcacgctctagaaaaatctcatcttaattaagggaacaacaaatcatttaatcttcagagcatcttagactgaaaacctttcaactgtgctgaaaaacctagaagacagaccattttgcccaccctctcatttaaaaggaattgaagaagaaataaaatggcagaggtttaaggttactattcaggatgactgatgataattcagatgataaaatagaagatgaattgcaaaccttctttaccagtgataaagatggaaatacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaggagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacccagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctggaaagcctacatccttgaaaactgcacagtcgtcatgggtgaatttgcctagaccacttcctaaatccaaagcatctttgaaaagtcctgcgctgcggaggacaggaagcaccccctcaatagccagcacccacagtgagctgagcacttacagcaacaattctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactc

SEQ ID NO: 2452 - DNA, 3731 bp, Homo sapiens
acagtgtgatgtggttcagaggcagcttctagacctgcaggagggagattgtattcagaggaagagcatcattttggcaacatctgaaagtgaaaacggaagccagaaacacttggccagccctgggggatttttttcttctatgcctctctggtggaatgacatttgctgtgtaggcatctttcctctgactgtatttcttggccttgaagagtactgagtttaaaaagacagtatgtgacagtccatggaaattgcctcttctgtgaaatctcgccacctgctccgaagacatgttgttgtctcccaaattctccttatccaccattcacatacgactgacggccaaaggattgcttcgaaaccttcgacttccttcagggtttaggagaagcactgttgttttccacacagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaa

SEQ ID NO: 2453 - DNA, 3996 bp, Homo sapiens
agtactgtgtctgatgctcctaaggaggctgtaaagtgcttttgtccattcctttttgtcttttaacaaaggggtttaccatacacccacagagcctgtctagtggcgatgtgttcctgttgcggattaagcattcaaatcagtgagtctctttcttagtttgatttgctagctggtttaatctgttttgtgtagtgccttggagcttacgcatttttttttttttccctccattcgaattcactaagagcaagcatgagggatatgagagtgaacatggctgcagtttttcctgcttaagcttgctttgatccttttaaatgactgtaccaggaggatttcgcagttgtacagaaactgatatttcttcaaaaatctttatcaattctacactcaccccaccggctggttcagagaggcactatgatgctaccttattgacactgctggtcgtgggatcgtacagcctttgtataattcctttgttagccacgtttactgggaaaaaaactggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactc

SEQ ID NO: 2454 - DNA, 2787 bp, Homo sapiens
aaagggggcggcagcgccggcggagcggaggcgggtctcacgtgggccagcgcagagcctgcggaagggacggatgcggatctcgtcgctgtcaccttgaaagtgaccgaggggcttgactgtggactccttacgccgcccacccgggcccggcggtcccagccttctcgcagggccccttctcagcagaagcaagcggggccgagaaagcgggtggaatagggttgctgcaggtcccaaagacccctcgtggcgcctcgctactttctgcagcttgtttgcactttttcacgctctagaaaaatctcatcttaattaagggaacaacaaatcatttaatcttcagagcatcttagactgaaaacctttcaactgtgctgaaaaacctagaagacagaccattttgcccaccctctcatttaaaaggaattgaagaagaaataaaatggcagaggtttaaggttactattcaggatgactgatgataattcagatgataaaatagaagatgaattgcaaaccttctttaccagtgataaagatggaaatacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaggagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacccagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctgttttgccaaaagctgctttctcatga

SEQ ID NO: 2455 - DNA, 6256 bp, Homo sapiens
aaagggggcggcagcgccggcggagcggaggcgggtctcacgtgggccagcgcagagcctgcggaagggacggatgcggatctcgtcgctgtcaccttgaaagtgaccgaggggcttgactgtggactccttacgccgcccacccgggcccggcggtcccagccttctcgcagggccccttctcagcagaagcaagcggggccgagaaagcgggtggaatagggttgctgcaggtcccaaagacccctcgtggcgcctcgctactttctgcagcttgtttgcactttttcacgctctagaaaaatctcatcttaattaagggaacaacaaatcatttaatcttcagagcatcttagactgaaaacctttcaactgtgctgaaaaacctagaagacagaccattttgcccaccctctcatttaaaaggaattgaagaagaaataaaatggcagaggtttaaggttactattcaggatgactgatgataattcagatgataaaatagaagatgaattgcaaaccttctttaccagtgataaagatggaaatacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaggagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacccagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctgctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaattgc

SEQ ID NO: 2456 - DNA, 3160 bp, Homo sapiens
atgggctgccccagcagcaaactgtgcctctattctccatgtgcagcaacaaggcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaattgc

SEQ ID NO: 2457 - DNA, 4089 bp, Homo sapiens
aaacattttatttcttccagggaacaacaaatcatttaatcttcagagcatcttagactgaaaacctttcaactgtgctgaaaaacctagaagacagaccattttgcccaccctctcatttaaaaggaattgaagaagaaataaaatggcagaggtttaaggttactattcaggatgactgatgataattcagatgataaaatagaagatgaattgcaaaccttctttaccagtgataaagatggaaatacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaggagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacccagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctgctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcactt

SEQ ID NO: 2458 - DNA, 3650 bp, Homo sapiens
tatgagagtaagtagctgcataccctggcacttcaggaatactgggatatgtgacttgcaattaaacaggattgttaccagctttactgttggaattttgaaggtgtggcacaaaatcaggcttgcatgtaagagggaactctgaatttgaaaagctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaattgc

SEQ ID NO: 2459 - DNA, 12034 bp, Homo sapiens
gtgaggatgtgccgggtggtcctttcctcctcctcttcctcctcctcccggctccctgcctagtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggaatccgatcatgggacacaaacctgattgaatgcaacttggaccaagaactcaaactttttgtatctcgacactctgcaagattctctcctgaagtcccaggacaaaagatccttcatcaccgaagtgacgttttagaaacagtggtcctgatcaacccttctgatgaagcagtcagcaccgaggtgcgcttaatgatcactgatgctgcccgacacaagctgctcgtgctgaccgggcagtgctttgaaaataccggagagctcattctccagtccggctctttctccttccagaacttcatagagattttcaccgatcaagagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcattcttttccaaaaaatgggagtaggtaaacttgagatgtatgtgcttaatccagtcaagagcagcaaggaaatgcagtattttatgcagcagtggactggtaccaacaaagacaaggctgaattcattctgcctaatggtcaagaagtagatctcccgatttcctacttaacttcagtctcatctttgattgtgtggcatccagcaaaccctgcggagaaaatcatccgagtcctgtttcctgggaacagcacccagtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccaataaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtactcatatgacataagtgaaaagaccaccagcccccccgaagtgagtggttacagctatgaaaagactgagaggtctagaaggcttctggatgacatcagcaatggctatgatgactctgaggatggtggccacacacttggggaccccagctactcttatgaaaccactgagaaaattaccagtttccctgagtctgaaggttattcctatgagacatctacaaagacaacacgaacccctgatacttccacatactgttacgagactgcagagaaaatcactagaacccctcaggcatccacatattcctacgagacttcagacctatgctacactgcagaaaagaagtccccctcagaagcccgtcaggatgtcgatttatgcctcgtgtcctcttgtgaatacaagcaccccaagacagagctttcaccctctttcattaatcccaatcctcttgagtggtttgccagtgaagaacccactgaagaatctgaaaagcccctcactcaatcagggggagccccaccgcctccaggaggaaagcaacagggccgacagtgtgatgaaacccctcccacctcagtcagcgagtcagccccatcccagaccgactctgatgttcccccggagactgaagagtgcccctccatcacggccgatgccaatatcgactctgaagacgagtcggaaaccatccccacagacaaaactgtcacgtacaaacacatggacccacctccagctcccgtgcaagaccgcagcccttcgccacgccaccctgatgtgtccatggtggacccagaggccttggccattgagcagaacctgggcaaagctctaaagaaagatctgaaagagaagaccaaaaccaaaaagccaggtacaaagaccaagtcatcttcacctgtcaaaaagagtgatgggaagtctaagcccttggcagcttcaccaaaaccagcgggcttgaaagaatcctcggataaagtgtccagggtggcttctcctaagaagaaagaatctgtggaaaaggcagcaaaacccaccaccactcctgaggtcaaagctgcacgtggggaagagaaagacaaggagaccaagaatgctgccaatgcctctgcatccaagtcggccaagaccgccactgcaggaccaggaactaccaagacgaccaagtcatctgctgtgcccccaggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataacacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttttttttttttttgctatgggatttaatgggaaaaatatgtaaaaactgtcactagtcagctggctctttttcctatgaaatctatcagtacctttctccatccgttgttctcaatatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagtt

SEQ ID NO: 2460 - DNA, 982 bp, Homo sapiens
gtgctcccggaaaggcactgggcgaccgcacccgtggctttctctgggcgaccgggtcccagactccccccagcacagcagagcgcttccctgcccacccgcggaaaccgccccaggtgggccgcgccccctccccagcagccagcagggcgccagggctgagccggccgtggaggggagcgggtcccgcgggttatacaggcgccggggctccgcggcaggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaat

SEQ ID NO: 2461 - DNA, 894 bp, Homo sapiens
gagcgagtgagcgcgcggcggcccctggtccgcccggccgcggccgatctaggggctgggggctggaggcgggggtgggggtctgagctgcgtcctgggctcgaggcgtcccccggggagtcgcctcttagcggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaat

SEQ ID NO: 2462 - DNA, 828 bp, Homo sapiens
ttctggagacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaa

SEQ ID NO: 2463 - DNA, 606 bp, Homo sapiens
agaccggttctggagacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaat

SEQ ID NO: 2464 - DNA, 1166 bp, Homo sapiens
cggcttcccgcttcccgcggagaacaacaatgaaagtgaaagaggggtggggcgggggcgagcccgggttctgtggcccatttgccctgtggccttgagcaagcccctcccccaggcctcgggggctctcccggtttgggggaaccgggcgaggcaatgccacaggcccagggttagagggggtgggcacttgcagctgccgatgtggctggatctggaacttctcagacggctcctgtcagcgccaagtttcaccaaatccaggcctgcgggctcctcccccaggacccccactcgcagtccctcaagcctgtgctcccggaaaggcactgggcgaccgcacccgtggctttctctgggcgaccgggtcccagactccccccagcacagcagagcgcttccctgcccacccgcggaaaccgccccaggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttcccccc

SEQ ID NO: 2465 - DNA, 981 bp, Homo sapiens
gtgctcccggaaaggcactgggcgaccgcacccgtggctttctctgggcgaccgggtcccagactccccccagcacagcagagcgcttccctgcccacccgcggaaaccgccccaggtgggccgcgccccctccccagcagccagcagggcgccagggctgagccggccgtggaggggagcgggtcccgcgggttatacaggcgccggggctccgcggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaatata

SEQ ID NO: 2466 - DNA, 1026 bp, Homo sapiens
gagcgagtgagcgcgcggcggcccctggtccgcccggccgcggccgatctaggggctgggggctggaggcgggggtgggggtctgagctgcgtcctgggctcgaggcgtcccccggggagtcgcctcttagcggtgcgtccgggctagcggcgaggggccgccccaagtcttcccaccgccgccaccttagcagcccgacttggggcctggaaagtggagcacgcggaggtgggagggccctgcacgcggcccccggtggggaaggggacgggccagggattcagactcgggctctcccctcaggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaa

SEQ ID NO: 2467 - DNA, 540 bp, Homo sapiens
ggtgggcacttgcagctgccgatgtggctggatctggaacttctcagacggctcctgtcagcgccaagtttcaccaaatccaggcctgcgggctcctcccccaggacccccactcgcagtccctcaagcctgtgctcccggaaaggcactgggcgaccgcacccgtggctttctctgggcgaccgggtcccagactccccccagcacagcagagcgcttccctgcccacccgcggaaaccgccccaggtgggccgcgccccctccccagcagccagcagggcgccagggctgagccggccgtggaggggagcgggtcccgcgggttatacaggcgccggggctccgcggcaggcaagagaagctgaggcctgagaacggcccgggccttggcgatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagc

SEQ ID NO: 2468 - DNA, 477 bp, Homo sapiens
agccagcagggcgccagggctgagccggccgtggaggggagcgggtcccgcgggttatacaggcgccggggctccgcggcaggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaag

SEQ ID NO: 2469 - DNA, 686 bp, Homo sapiens
agaccggttctggagacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaatata

SEQ ID NO: 2470 - DNA, 3619 bp, Homo sapiens
ggcgagcgcacgcgcacagcgccgggccgcacacctccgggctctgggcggagcgcctcgggcgttgtaggcgggaccggaccctctggcccgcccctccgtgtcccttctggtcgccagtggacgccgacgtcatgacgtcgcgttccgtagggctcttcccgggctttggtgggtcacgtgaaccacttttcgcgcgaaacctggttgttgctgtagtggcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatat

SEQ ID NO: 2471 - DNA, 3144 bp, Homo sapiens
acttttcgcgcgaaacctggttgttgctgtagtggcggagaggatcgtggtactgctatggcggaatcatcggaatccttcaccatggcatccagcccggcccagcgtcggcgaggcaatgatcctctcacctccagccctggctggggcctgggccgcatgcgccgtgggctcctgtatgacagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatat

SEQ ID NO: 2472 - DNA, 3237 bp, Homo sapiens
gttgttgctgtagtggcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcaggccgtgggctcctgtatgacagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaaggaaagctccagaaatgcatccctggcagaggctggtattggtgccattccttcccagctcttggccatcgaacctagtctgcgaagatctggggttcccataggagaggtgggtgtttctcagcgtcaggaagccaggagcttcagttcagccaacacacattggttcctggaagacctcctagggccaagttgtagggatacaatgatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacat

SEQ ID NO: 2473 - DNA, 3116 bp, Homo sapiens
ctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacacatggtcttaa

SEQ ID NO: 2474 - DNA, 3262 bp, Homo sapiens
ctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccagagacgggatctcaccatgttgcccaggctggtcttggactcctggcctcaagcagtccttctacctgagcctcccaaaaggctgggattacaggcataagccactgtgcttgtttgatctcattctttttaatgactgcagggtttccatggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacacatggt

SEQ ID NO: 2475 - DNA, 2720 bp, Homo sapiens
gactttggtggaggtagttctttggcagcgggcatggcgggtaccgtggtgctggacgatgtggagctgcgggaggctcagagagattacctggacttcctggacgacgaggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgtttttttt

SEQ ID NO: 2476 - DNA, 1030 bp, Homo sapiens
cgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccagagacgggatctcaccatgttgcccaggctggtcttggactcctggcctcaagcagtccttctacctgagcctcccaaaaggctgggattacaggcataagccactgtgcttgtttgatctcattctttttaatgactgcagggtttccatggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtc

SEQ ID NO: 2477 - DNA, 3169 bp, Homo sapiens
agagaactcagccaatcataatgcttatatgctcccaaggtccccgcctcttcctcgaggtaacctttggtggcgggaagagttcggaagttttcgcgccggggtggagtcatcctgggaacctccacgcgactttggtggaggtagttctttggcagcgggcatggcgggtaccgtggtgctggacgatgtggagctgcgggaggctcagagagattacctggacttcctggacgacgaggaagaccagggaatttatcagagcaaagttcgggagctgatcagtgacaaccaataccggctgattgtcaatgtgaatgacctgcgcaggaaaaacgagaagagggctaaccggcttctgaacaatgcctttgaggagctggttgccttccagcgggccttaaaggattttgtggcctccattgatgctacctatgccaagcagtatgaggagttctacgtaggactggaaggcagctttggctccaagcacgtctccccgcggactcttacctcctgcttcctcagctgtgtggtctgtgtggagggcattgtcactaaatgttctctagttcgtcccaaagtcgtccgcagtgtccactactgtcctgctactaagaagaccatagagcgacgttattctgatctcaccaccctggtggcctttccctccagctctgtctatcctaccaaggatgaggagaacaatccccttgagacagaatatggcctttctgtctacaaggatcaccagaccatcaccatccaggagatgccggagaaggccccagccggccagctcccccgctctgtggacgtcattctggatgatgacttggtggataaagcgaagcctggtgaccgggttcaggtggtgggaacctaccgttgccttcctggaaagaagggaggctacacctctgggaccttcaggactgtcctgattgcctgtaatgttaagcagatgagcaaggatgctcagccctctttctctgctgaggatatagccaagatcaagaagttcagtaaaacccgatccaaggatatctttgaccagctggccaagtcattggccccaagtatccatgggcatgactatgtcaagaaagcaatcctctgcttgctcttgggaggggtggaacgagacctagaaaatggcagccacatccgtggggacatcaatattcttctaataggagacccatccgttgccaagtctcagcttctgcggtatgtgctttgcactgcaccccgagctatccccaccactggccggggctcctctggagtgggtctgacggctgctgtcaccacagaccaggaaacaggagagcgccgtctggaagcaggggccatggtcctggctgaccgaggcgtggtttgcattgatgaatttgacaaaatgtctgacatggatcgcacagccatccatgaagtgatggagcagggtcgagtgaccattgccaaggctggcatccatgctcggctgaatgcccgctgcagtgttttggcagctgccaaccctgtctacggcaggtatgaccagtataagactccaatggagaacattgggctacaggactcactgctgtcacgatttgacttgctcttcatcatgctggatcagatggatcctgagcaggatcgggagatctcagaccatgtccttcggatgcaccgttacagagcacctggggagcaggatggcgatgctatgcccttgggtagtgctgtggatatcctggccacagatgatcccaactttagccaggaagatcagcaggacacccagatttatgagaagcatgacaaccttctacatgggaccaagaagaaaaaggagaagatggtgagtgcagcattcatgaagaagtacatccatgtggccaaaatcatcaagcctgtcctgacacaggagtcggccacctacattgcagaagagtattcacgcctgcgcagccaggatagcatgagctcagacaccgccaggacatctccagttacagcccgaacactggaaactctgattcgactggccacagcccatgcgaaggcccgcatgagcaagactgtggacctgcaggatgcagaggaagctgtggagttggtccagtatgcttactttaagaaggttctggagaaggagaagaaacgtaagaagcgaagtgaggatgaatcagagacagaagatgaagaggagaaaagccaagaggaccaggagcagaagaggaagagaaggaagactcgccagccagatgccaaagatggggattcatacgacccctatgacttcagtgacacagaggaggaaatgcctcaagtacacactccaaagacggcagactcacaggagaccaaggaatcccagaaagtggagttgagtgaatccaggttgaaggcattcaaggtggccctcttggatgtgttccgggaagctcatgcgcagtcaatcggcatgaatcgcctcacagaatccatcaaccgggacagcgaagagcccttctcttcagttgagatccaggctgctctgagcaagatgcaggatgacaatcaggtcatggtgtctgagggcatcatcttcctcatctgaggaggcctcgtctctgaacttgggttgtgccgagagagtttgttctgtgtttcccaccctctccctgacccaagtctttgcctctactcccttaacagtgttgaattcaactgaaggcgaggaatgttggtgatgaagctgagttcaggactcggtggaccctttgggaatgggtcatgaaagctgccatggggtgaggaaagaggagacagtgggagaggacaatgactattgcatcttcattgcaaaagcactggctcatccgccctacttcccatcccacacaaacccaattgtaaataacatatgacttctgagtacttttgggggcacaactgttttctgtttgctgtttttttgttttgttttttttctccagagcactttggtctagactaggctttgggtggttccaattggtggagagaagctctgaggcacgtcatgcaggtcaagaaagctttctttgcagtagcaccagttaaggtgaatatgtattgtatcacaaaacaaacccaatatccagatgaatatccgagatgttgaataaacttagccatttcgtacacatggtcttaa

SEQ ID NO: 2478 - DNA, 4183 bp, Homo sapiens
gtctcgcggtttgggagcgctactcgccaggtggactcggagtccgcgagcgtcgtcggcaagcggccgcctttccacggtaaccgcgcgccggcggggagggcgtggcgcggagccgacgggaacgtccgcgctgcggagcagggcagggaagccgggaggcgggcccggcccgagcttgtccttgtcgcgcaggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcttgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaa

SEQ ID NO: 2479 - DNA, 3111 bp, Homo sapiens
actcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcttgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctc

SEQ ID NO: 2480 - DNA, 4105 bp, Homo sapiens
aggggcggagacgaccttgccgccggcgggaactctgggtctcgcggtttgggagcgctactcgccaggtggactcggagtccgcgagcgtcgtcggcaagcggccgcctttccacggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagccatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcttgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaa

SEQ ID NO: 2481 - DNA, 2606 bp, Homo sapiens
aatcgctggccgcgaggctccggcgaaccaatgggagcgcagcggctgcggcgtccgaacaccgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggta

SEQ ID NO: 2482 - DNA, 2402 bp, Homo sapiens
ttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggt

SEQ ID NO: 2483 - DNA, 739 bp, Homo sapiens
tcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagtcttgcaccttcattgattgagcacctgctgcctgccagatactgttctgggtgctgggctgcagcactgaagctggacctggctcctgcttctagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacac

SEQ ID NO: 2484 - DNA, 1369 bp, Homo sapiens
gcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagcatcgagaagcagctcaagcgccgctttgccattggctcccaggtgtctga

SEQ ID NO: 2485 - DNA, 2631 bp, Homo sapiens
gtagacgtcctaccccgtgatattaaagcaagatggccgcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttgccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcgtgttttgagagttaataatcttttgcttggttatactaggctaggaagcaatatcaaagcccttaaattctcaagactaaagacttgagattatataaaattatccagaatcattcagctaatactattggaatatagtatgtagggtgaaagttgacagaaatctgtacttcttcaggaaatcctcactggtaattgttttgaacattaatgaaagccctataaaatagaaagattggaaatcaccattgtttcctattatccacagtgtggatggatacttatttggtgacctagttatgggagaattgagtaacgttagttattttatatcataccataaaaatattttctt

SEQ ID NO: 2486 - DNA, 2961 bp, Homo sapiens
ggccgcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccagacggagttttgctcttgttgcccaggatggagtgcaatggtgcgatctcggctcaccacaacctccccctgccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcgtgttttgagagttaataatcttttgcttggttatactaggctaggaagcaatatcaaagcccttaaattctcaagactaaagacttgagattatataaaattatccagaatcattcagctaatactattggaatatagtatgtagggtgaaagttgacagaaatctgtacttcttcaggaaatcctcactggtaattgttttgaacattaatgaaagccctataaaatagaaagattggaaatcaccattgtttcctattatccacagtgtggatggatacttatttggtgacctagttatgggagaattgagtaacgttagttattttatatcataccataaaaatattttc

SEQ ID NO: 2487 - DNA, 2174 bp, Homo sapiens
cgtgatattaaagcaagatggccgcgccctgcagattgtctcttgttgcgtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccagacggagttttgctcttgttgcccaggatggagtgcaatggtgcgatctcggctcaccacaacctccccctgccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaa

SEQ ID NO: 2488 - DNA, 2837 bp, Homo sapiens
taaataaataaataaataaaaataaaaaataataataataaaaaaagcccgcacgaactaggaaagaaaatacacaaccggccctccgtgcgatcacccatctccctcaccaggaaagtagctccaaaccgccaatcagcggcgacgctggacgtagacgtcctaccccgtgatattaaagcaagatggccgcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaacagagtgttgctctgttgccaggctggagtgcagtgatatgatctcccagcttcaagcgatcctcctgcctcagccctccctagtagctgggactgcaggcatgcaccacaacacccagggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattca

SEQ ID NO: 2489 - DNA, 10857 bp, Homo sapiens
taaataaataaataaataaaaataaaaaataataataataaaaaaagcccgcacgaactaggaaagaaaatacacaaccggccctccgtgcgatcacccatctccctcaccaggaaagtagctccaaaccgccaatcagcggcgacgctggacgtagacgtcctaccccgtgatattaaagcaagatggccgcgccctgcagattgtctcttgttgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatcttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaccttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcagcgtgttttgagagttaataatcttttgcttggttatactaggctaggaagcaatatcaaagcccttaaattctcaagactaaagacttgagattatataaaattatccagaatcattcagctaatactattggaatatagtatgtagggtgaaagttgacagaaatctgtacttcttcaggaaatcctcactggtaattgttttgaacattaatgaaagccctataaaatagaaagattggaaatcaccattgtttcctattatccacagtgtggatggatacttatttggtgacctagttatgggagaattgagtaacgttagttattttatatcataccataaaaatattttcttaagaaattgtcatggccatcatttcttaataatgaagacaggtccatagtaactggtgagtggtgtttccctgtttttaagtcagaatgacagaaaaaacagaatagtggtagtacccctcttcctctccagtacttcaatggtatgtcttcacaggggttagagtgggataatcagctgggccttttgactcagatacctcagatacctcaaccattctaaatagactaagggatgaatacagccaaatgggccagacagccctgcttgtctctggaattccaacccagatctctggtgtcagcctagggagaagctcccgtgtcaccttcgggccaaagcaggtactcaggagagttctaagggccccaaagtcactttggctacagatgtgtatgttaagcctgattatgggtgtgaggcaaccaagtatcttgttactataattgcatatggccacttggaggtagcttagttttcttgggtttattttatctaattttagtctttccagaaagcagtaagattagtagcaagtaaaaagtatttgtagtgctggataatttaggaatgatgaatattttttaatacttgattcagtgatttcaaaaggtcgtaacttttagtcatagctactcctgggcaaaattcttcttacagagacaatattaattacaataccacattgtgtatatattttgaaaagaggctggttgcagcagctcacgcctgtaatcccagcactttgggaggctgaggcgggtggataacctgaagtcaggagttcaagaccagcctggccaacatggcaaaaccccatctccactaaaaataccaaaattagccaggcgtggtggagcaagcctgtagtcccagctactcaggaggctgaggcaggagaatcgcttgaacccaggaggcagaggttgcagtgagctgagattgtgccactgcactccagcctgggcgacagagtgagactgtttcaaaaaaaagaaaaagaaaagaaggtattttgtgtttttgtgctacccgttcagcaaaataatgaaattcattgtttctaaacttttttttctgattaaatacaagagtaaaaaaagtgaatggagtgccttttgaatagaatataacaaaaatttatcttaaagaaacgggaagtaacctggcacagtggctcacgcctgtaatcccagcactttgggaggctgaggcaggtggatcacgaggtcaggagatcgagaccatcctgcccaacatggtgaaaccccatctctactaaaaatacaaaaattagctaggtgtgttggcacgtgcctgtagtcccaactactcaggaggctgaggcaagagaatcacttgaactcaggaggcagaggttgcagtgagccaagatcatgccactgcactccagcctggcaacagagtgagactctgtctcaaaaaaaaaaaaagaaacaggaagttcaaatattttgggaggttcttgacagctacaatttggggctagtgacactatacacatataaagaaactttaaagtttcttagtaatgaaggtttgtaatgctattccattacaatagtaactgtctcactgaaaaatgtttcatggaaaatacatattttagattctatgatttgctttaggatgtgaacttctttattttttagagacagggtctcactctgttgcccaggctgtagtgcagtggtacaatcatagctcactgcagccttgatctcctgggctcaagtgatccttatgcctcagcctcccaagtggctgggactacaggcacatgccaccatgcctggctaagttttaaaaaaattttttgtaggaatgaagtctcactatgttgcccaggctggtcttgaacttctggcctcaaatgatcctcttgccttggcctcccaaagtgctcagattacaggcatgagccaccacacgtggcctgaaacctctttaaatccacaatgtttgtatgttaacttaaacaaaattacatcacttaatatgtcaaaacagcctaccctctggtgctgctatgcagaagtactacagaatatgatgccctaggaagaaatcagctaaaaatgtaaccttactcaatgtagttacttcatagaaatcccatcactgacaataatcagctgccaacgaaagctggccatacttgtgacttcctctattcaccacagaccagactgcctaccagttgaaaaagccaggtattttttcaattcaattcaacaggaacaccaaaaaataagaaatgactaagaaacactaagcatttgtaaaattactgggggaggaaggatgaagatacgaacctatgctaaattaaacgattatggccttgaaaatgaagttcctttatagccaagagcttaaattttgttactgatggttttaaaagtattttgtcattttttagtttcaacctagattggaatagccatggcttttctacttcagaaatttcaactcctagaagaatgccctgtccagaagaagtggtcaggagtatcaggaaagccaccagcagagactaggggtttattctgatctggaagagccacttaacactggaatgcacacagtgaaaattaattgttcctcttacactccctctccacaatacttctattattacacttacttcgttctaccttaatgtttttatttagagacaagatctcactctgccaccctggctggagtgcagtggcatgattacagctcactgcagcctcaacctccctggctctagctattctcccatctcagccctccaagtagctgggactacaggtgtgcaccaccatgcacggctaatttttaagtttttgtagatatggggtcttactatgttgcccaggctggtctcaaagtcctgggctcaattaatcctccctcttcagcctcctgtgtaggtgatagtacaggcatgagccaccatgtgcctggccctaccttaatgttaatatctgtctaccttaagaagatataagccttgtaaatataagcaatatcacagttgtagatactcgtgctttttaaatagattaatgaatactactaaaggcaagaaatggtattactaaaactcaagtgaataattaaatgagatcaaaatatttgtgacaggccaggcacggtggcttacgcctgtaatcccagcactttgggaggccaggcggatcacttgagctcagcagttcaagaccagcctgggcaacatggcgaaactccgtctttaccaaaaatacaaaaataagccaagcatggtggcacgtacctgttgttccagcaacttgggggctgaggcaggagaatcacttgagccggggagtttgaggctgcagtgagttgatagcatgccaccacactccagcctgggcaacagagtgagaccctgcctgaaaaaaagcccaggtgtggtggctcacatctgtaatcccagcattttgggattacaaatctgccagcgcaagcagatcacttgaggataggagtttgagaccagcctgaccaacatgttgaaaccccatctcttattaaaatacaaaaattagctgggcgtggtggcatgcgcctgtaatccgagctactcaggtggctgaggcacaagaatcgcttgaacctgggagatggaagttgcaatgagctgagatcaagccactgcactccagcctgggcaacagagcaagactgtctcaaaaaaaaaaaatttgtacagtcatgttcaaagtagcattaattcacaatagccaaaagctggaagtagcccaagtatccaccaatgaatgaaaggataaacaaaatgtggcatatacatacaatggaatattatacagccttaaaaaggaaggaaattcatatacatgctacagcatggataaaccttgaaaaagttatgctaactgaaatcagccagtcacaaaaagacaaatactgtatgattccctttataagagttacctggagcactcaaattcatagagacagtaaaatgatggttaccaggggatgggggagggagaaacaggaaactattctttagtgagtacagaatttcagtttttttgttttgtttttgtttttgtttttgagatggagcctcacactgtcacccaggctggagtgcaatggtgtgatcttggttcactgcaacctctgcctcctaggttcaaatgattcttctgcctcagtctcctgagtctgggattacaggcgcctgccatcatgcccagctaatttttgtatttttaatagagacagggtttcacaggttggccaagctagtctcgaactcctgacctcatgatccgcccacctcgacctcccaaagtgctgggattacaggggtgagccaccatgcccagtccagaatttcaagttttgcaagatgaaaagagttctggagatggttgatggtgatggttgcacaacaatttgaatattttaaatgccaatgaactgttcatttacaaatggttacgatggaatttttctttttcttttttttttcttgagacggagtctcgctctgtcactcaggctagagtgcagtggcactatctcggctcactgcaacctcctcctgctgggttaaagtgattctcttgcctcagcctcccgagcagctgagactacaggcgcgtgccaccatgctcagctaattttttctatttttagtggagacagggtttcaccatgttagccagatggtctcgatctcctgacctcgtgatccacctccctcagcctctcaaagtgctgggattacaggcatgagccaccgtgcacagccaagatggaaatttttatgttctttgtttgatatggtttggctgtgtccccacccaaatctcaacttgaactgtatctctcagaattcccacatgttgtgggagggacccacagggaggtaattgaatcacaagggccggtttttaccatgctttcttgtgatagtgaataagtctcacaagatctgatgggtttatcaggggtttccgattttgcttcttcctcattttctcttgccactcccatgtaagaagtgcctttcgcctcccgccaagattctgaggcttcctcagccatgtggaactttggggacgaaaagaggtttaattggacttaaagttccaattaaagtttcaggtatgtctttatcagcagcatgaaaatgaactaatacagtgttttatcactttttttttttttttttttttttgagatggagtttcgctcttgttgcccaggctggagtgcaatggcgcaacatcaggtcactgcaaactctgcctcccgggttcaagcgattctcttgcctcagcctcctgagtagctgggattacaggcttgtgccaccacacccggctaatttttgtatttttagtagagacagagtttcaccatgttggccaggctagtcttgaactcctgacctcaggtgatccacccaccttggcttcccaaagtgggtggatgacctctgggattacaggcgtgcgccaccgcgctcggtctatattcaccaattttaagatgcacatctttccatattttagtatctctaagttggagtatgtcttacaattaatggcatctgacagttataactggcagcatttgtgactgaaaaacatcttagatgcaatgaaatacagtgtgtgtgtttgtattgtgctgcaatataaaatgtatttcaggccaggtatggtggttcacacctgtaatcccagcactttggaaggccaaagtgggaggatcacttgagcccaggagttcaaggctgcagtgagctctgattataccactgtactccagcctaggcaacagagcaagacccagtctctaaaaaataaatgaaaatgtttcttattgtggatcacagtcaaaagtttgaaaaaacacaatctgtttgaacagcactactttctgacaggaaaaccccaacaggttaggatctgtgtattcctcagagtaagaatttttctaaaaagtttttaaaaacttaaagtcttactgatctcttcctatgctccaattttatagatataacttagccttgcgaggtgatgtaattaaagtctaacttcaagttgctgttgagcatagatctcaggtcttctgacttcacaacacctttctgccactttcagtggatttttccctcctagggaccagaggtcctctactggattaaaagtttctccatcccggcagggtgcggtggctcacgcctgtaatcccaacactttgggaggccaaggcgggcggatcacgaggtcaggaaatagagaccatcctggctaacatggtgaaaccccgtgtctactaaaaatacgaaaaattagccgggtgtggtggtgcgcgcctgtagtcccagctactcgggaggctgaggcaggagaatggcgtgaagccaggaggcggagcttgcaatgagccgagatcgcgccactgcactctagcctgggcgacaaagcgagactctgtctcaaaaaaaaaaaaaaaaaaaaaaaattctccatcccttttgaacaatctggaagtctgtttctcttaaccttcagttcccattccaatcctttgtaacctatttcaggttaagcatttatggaggtgccatgcttaattagccattatggcactcactctatttcaaaggttatcccagaatttggaggctgtaggggaattcagagtgtgaatttcacttgaacagcaccctctgcagacttaaaatattcctcctatatctgaagacaataataatttcttagaatttgctaggctaaacaactattttttagtccagtggcttgtaattaagtcatttttagtctttaattatgttggttgcttttagaattctcttttagagttggtctacatccttttaaaacatgggcaatccaaatttataacagtaaattaagatacataaaaaaaaacactggctaaatttaaaaggaaacacttctagaatatactgtattttgacacaagaccagactgtgctatgtgtatgtggtgtttcaagtaatttaagaaaactgttggaattttctgtatttccagtttcacaagaaacaacctcaaggagggcagtttaactgaaaattcagaggtattatagctctgaagaaaaatactgatgagcagttatacaaaatgagaaattgagttctaagaaatgcatccctaacttcaacataaagatagctatgagaaaacattctttgtacccaaccataaatgaataaaaatcacctcatttctcatcagatgtttactgggttgctagttatatatagaatcctgcaagaggctcaacagggaagtccaaagagtcaatcaagaaggtatgataatggctaaagatggggactgtaggtcaatgctccacgaggttcttcttttgttgcaccaatatagctgcactgttatacccatatggttacaatccaggcctcagaaaatgttgcagatgccctcaccagaaggctgagaaccagttcctcagtttgcatgcctccagacagcactagaagtcaaactcaaattgcttacatggtaacttggtttatcccaacaccaactaggatattccctcaatcacatgattgtactgaaaatataaccaagttttatttatgtttttcatttggtattagccatctggtatttaacctctgaaaaccacacaatcttctatacgcttttttcactggaataaatgaaactgcttacttttga

SEQ ID NO: 2490 - DNA, 11022 bp, Homo sapiens
aggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttggagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaagtaaactacccaaccacatgccacgtaatatttcagccattcagaggaaactgttttctctttatttgcttatatgttaatatggtttttaaattggtaacttttatatagtatggtaacagtatgttaatacacacatacatacgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatgcgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaatgctgctttatttcactaaattttgttgtgaggtgtcactaaaatgcctgcaaacaaacgtaactgctaatctgagaggaaaccctcttactaatcagagaagaaaccctcctgtcagaaaccttcagggaagtgagctgatcacacctaaactgggagtttgcaatggggtatttgaagcactgtgggagtattccactggccctctccctgagagacttaacagtcttccctgttgtccagattctgtataaggcaatcagaataatcatcttccttgttcagcagaggagcctggtcccattttccccactttgtgatgggcttctctcagcggtagctcagcagttccagatggcagtttggaccagcatctaggctggccagttcgctgtgtttacttagaaccaacacgttcagagctggcctggaccatctgaggggaacaggaaacacccctaggctgtggaagcaagtgcagacccccacccccggccctgaagccaagggggcagggtttgggagtggccaaagagaagcagtgcagggatgggttttcctagggacaggcttagcattcctgactctaggaagaaggagcagtgaggcggagaaacagtggaggggatggtggcattgggccccatggggccgagatggacacagggctcgttctcttgagtctggtgccaaggacagctgaagacgacatcattttcaggtggagaggagagagtggagggagatcatgccctgtgatgtgtcttttgcaggtgaaggtgggagacaaggtctctgctgacgatgaggcagagccaccgtgaaagttgtaataggaggactgcccgccgctggaagggcctgcagtgacgctaggacaccctctgcctgcatgtcacgttagctgggctgggcgaagtagaagaccaaggggaagaggtgcagtggggagaccaggtgggatgcaaccacaggaccagtggaggggctgtggcacgtgggcggagactgagtggctgggcatgtgttgtggctgagcatgtggtgtgggcagtggtcctagaccccgccatgtccggacaatgatatagagcgtctcagcatcgccagtctagactgtctatggagagcagaaagttgtctggggctgcctggggaactgtgaggccagctatatcaccgtcgctgatggtgacattacggtggtggcaggagcaaggagagagggaagaaggaccccgtccagctttagtcacaaaatacccaatggaagatgccagtgccaatcctgtgggtttccttgggacttcacactggctttcttatctgctccagatccattcagtagtcactgagttcctgccaaatactttgtagcgccagaagccaggagcggggtctgcagcagggcagtccccattttcaggaaatgcctggagctgctggtccctgagagaaaggaaaacatctttcagccgtacgcaggccaagaaggccaatgtccagtagctttgtgattttttttatatttttttatttatttatttttgagatagagtcttgctctgtcgctcaggctggagtgcagtggcgtgatctccactcactgcaacttccgcctcctggggtcaagcagttctgcctcagcctcccgagtagctgggattacaggcacacgccaccacacccagctaatttttgtgtttttagtagagacggtttcaccatgtcggccaggctggtctcaaactcctgacctcagatgattcagcctcccaaagtgctgggattacaggtgtgagccactgcacccagcctgtgatgtttctgtggggttccacaaatgtgtgtgtgtgtaaaagctgatgattacagcaagaatgtgaacagtagcagttttccatttgaaggcaagttttgtctttatctgggtatcagaaggaccctctgggccattgtcgcttcctgtactcagagccaccctagtactacgggcacacacagaaaacagcagcctgcgtactttcaaaggaaaggcatctttaatcaccaatgcctggaaaaattattttgtttccctcttccttccgtcttgtttcctaacttcttaccaaagtttagagtctgagtttttcgtataataatgtcccacatccacacatcgggcctacagatgctctcccttgaatcgactggaaacatgacaccggttccatgctctggaactgtcacctgtgatgtgctgggctgtgtcccaagcacaggaatcccagcagtttcagctcgatgcagaaccaccatgctccagacacaggcttgggaaagacacgtcaaaattaaaatactaggtaagagaagcacctgattgggtagaagttggagaggaatcctggaattttgtggccagaaggagccactgccccttttgtttagtaagactagacagtaacagaagccagttgtcagctatgaaagtggtgggtgaagcaggggaggctcctctatggtgggaccctggacaagggaagccgaatgtgtgaagaaggggtgcgggggtgtgcggtgccctaggacactagggcaaaggtttcaaacctggaacaaggcactggaggaagatctgctgccagtcagcagtgcgggccctcgagttagcagtccgtgcgcagaggggccagttctgagaccagtttggagagtcaggcagtgacccattggccatgtcataattccttcagcctgcctcctctttaatcccagagagtgctctttcttcatacttcctttaaaatactaaattgttcccattccatggggagctggctaggctttacaggctaggaaatgtaggttttctgagatggaaccatctacacaaggaggaggaaggcactaagactacagatgagacccatgacagggctgagcatttggaagccaaccctggttgcttttcaagaattgctttgtggctgggtgcagtggttcacacctgtaattgcagcactttgggaggctgaggcaggtggattgcttgaacccaggagttcgagaccagcctgggcaacatatgggacaccccaccgcccccggctctgcaaaaaaattaaaaattagccaggcgtggtgtcatgagcctgtggtctcaactactcaggaggctgaggctggaggatcgcttgaacctgggaggtcaaggctccagtgaaccataattgtgccactgcactgcagcctgggcgacaatttgttttctaaattgcttttgaaagtctactgcattacatattccaaaaagcagtggttttcaaatacttttatcaccgatatccttttatgaaatgaaatcagtagaactttctctgctctgaataagcaagggtgggaacctgtctacctcccacagatagcataatgtgcctgccatagaggagccaaaaaatggtgatgggaactgagaggagagcaaatgtcacaaaagactgagcaattgagaaaacaaaacaagaccacagatgactgttaacgcctccacagtggaccaagaaaggacagagagctggcagcatgggcatcactgtctggtcggcagcaggaaggcctcgctagggaattgagtacagtcatctaactagtttaaaagtacaggaaggatgattaaggctattggagaggtcatacaaataggggaggggcaggcaatggctgataagacatgaatttgtaaggcgatgagtattgcagtcagcaaaacaaacgagactgctctcccaacacataactcagcagggaggccaggcattggtttaaccatttaatataaagaagttaaaattacaaatgcgctaagtgcctaaagaagaataagtgcaggaatgagagcagcatggactgccacagttttagaataagcactgtcactgctagattggaaacaaaaatccataaatttggcccggtgtggtggcggacgcctgtagtcccagctacttggaggctgaggcgtgagaatcgcttgaacccgggaggcggaggttgcagtgagccgagatggcgccactgcactccagcctgggcgtcagagtgagaactctgtatcaaaaaataaaaataaaaaaaagtccataaatctgcaatgtctcagttaagaaagaaagactgggccaatgcagatttcaaaccggagaaagtcatactgtcagtgaaggccgcctgtggccggaaggcgccaggggattagcaccctggactcagtgttgctgggaaacagggccccaaggctgggagcacagtgtttaaagggcatctacccaagaagggagcacagggcaaggaggagctgcaggggggcttggctgccaaagtgaattctgaggagagagctattgctgcctacgatatgcaggctgcacagaacacaagtggaatcagcaggcaggagaggcagctaacgacgcagcccgtttcttatttctgttttctcacaagcgatgaaagtggaaaagagggtgagcaggtggcccacacatgtgcctccagtgctgcggcccctccggggaccatcagccaggccccggggagggagccagccacagtgtgtccggctcttctctgaagggaagagagccttgaatagactgaagcgaagacggttctgcaaggacaaggcagaccgaaggcattggttttttttttcagataaggagaattagactcccaagtagacaccagagtcactgtttggttggtgggtgatagtggggtcacagtggctgcctgtgctcccccagggtgagcgtgactgtgctaacctgggtggggcagcatgcacacccctctggcagccctttgttgctcgctgatgacaagtttggatgatcccgccaaacagcttgctaagatgtagtccccagtgttggaggtggggcctgatgggaggtgctacccttgtgagataaggttgtgtaaaagcctgtggcacctccccacactgacgctctcacccctgctctggccatgtgccgcgcctgctcccacttccccttctgccaggagtaaaagcccccgagacctcccagaagccaagcagatgctagtgccatgcttcctctgcagcctgcagaactgtgagccaattaaacctcttttctctataaa

SEQ ID NO: 2491 - DNA, 1487 bp, Homo sapiens
gcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggtacctggagtttaatacagtgagctctagcaagggaggcgctgccttttgtttctagaatattatgttcctcaaggtccattattttgtattcttttccaagctccttattggaaggtatttttttaaatttagaattaaaaattatttagaaa

SEQ ID NO: 2492 - DNA, 1480 bp, Homo sapiens
gtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccatt

SEQ ID NO: 2493 - DNA, 951 bp, Homo sapiens
atggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttggctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaa

SEQ ID NO: 2494 - DNA, 2431 bp, Homo sapiens
cgccgcctccgccgccctccgctccgctcggctcgggctcggctcgggcgcgggcgcggggcgcggggctgggcccgggcggagcggcggctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtcatcgggcttctggacgtcttcacgccggccacgtccatcgaggacttcagcgaagtgtacttggtgaccaccctgatgggcgccgacctgaacaacatcgtcaagtgccaggcgctgagcgacgagcacgttcaattcctggtttaccagctgctgcgcgggctgaagtacatccactcggccgggatcatccaccgggacctgaagcccagcaacgtggctgtgaacgaggactgtgagctcaggatcctggattttgggctggcgcgccaggcggacgaggagatgaccggctatgtggccacgcgctggtaccgggcacctgagatcatgctcaactggatgcattacaaccaaacagtggatatctggtccgtgggctgcatcatggctgagctgctccagggcaaggccctcttcccgggaagcgactacattgaccagctgaagcgcatcatggaagtggtgggcacacccagccctgaggttctggcaaaaatctcctcagaacacgcccggacatatatccagtccctgccccccatgccccagaaggacctgagcagcatcttccgtggagccaaccccctggccatagacctccttggaaggatgctggtgctggacagtgaccagagggtcagtgcagctgaggcactggcccacgcctacttcagccagtaccacgaccccgaggatgagccagaggccgagccatatgatgagagcgttgaggccaaggagcgcacgctggaggagtggaaggagctcacttaccaggaagtcctcagcttcaagcccccagagccaccgaagccacctggcagcctggagattgagcagtgaggtgctgcccagcagcccctgagagcctgtggaggggcttgggcctgcacccttccacagctggcctggtttcctcgagaggcacctcccacactcctatggtcacagacttctggcctaggacccctcgccttcaggagaatctacacgcatgtatgcatgcacaaacatgtgtgtacatgtgcttgccatgtgtaggagtctgggcacaagtgtccctgggcctaccttggtcctcctgtcctcttctggctactgcactctccactgggacctgactgtggggtcctagatgccaaaggggttcccctgcggagttcccctgtctgtcccaggccgacccaagggagtgtcagccttgggctctcttctgtcccagggctttctggaggacgcgctggggccgggaccccgggagactcaaagggagaggtctcagtggttagagctgctcagcctggaggtagggggctgtcttggtcactgctgagacccacaggtctaagaggagaggcagagccagtgtgccaccaggctgggcagggacaaccaccaggtgtcaaatgagaaaagctgcctggagtcttgtgttcacccgtgggtgtgtgtgggcacgtgtggatgagcgtgcactccccgtgttcatatgtcagggcacatgtgatgtggtgcgtgtgaatctgtgggcgcccaaggccagcagccatatctggcaagaagctggagccggggtgggtgtgctgttgccttccctctcctcggttcctgatgccttgaggggtgtttcagactggcggctccagtgggccaaagggcaaccacatgagcatgggcaggggctttctccttggatgtgggacccacagcagcttcctgaggctgggggtgggtgggtgggtggtttggccttgaggacgctagggcaggcagcacacctggatgtggacttggactcggacacttctgccctgcaccctggcccgctctctacctctgcccaccgttgtggccctgcagccggagatctgaggtgctctggtctgtgggtcagtcctctttccttgtcccaggatggagctgatccagtaacctcggagacgggaccctgcccagagctgagttgggggtgtggctctgccctggaaagggggtgacctcttgcctcgaggggcccagggaagcctgggtgtcaagtgcctgcaccaggggtgcacaataaagggggttctctctca

SEQ ID NO: 2495 - DNA, 1512 bp, Homo sapiens
cgccgcctccgccgccctccgctccgctcggctcgggctcggctcgggcgcgggcgcggggcgcggggctgggcccgggcggagcggcggctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtcatcgggcttctggacgtcttcacgccggccacgtccatcgaggacttcagcgaagtgtacttggtgaccaccctgatgggcgccgacctgaacaacatcgtcaagtgccaggcgctgagcgacgagcacgttcaattcctggtttaccagctgctgcgcgggctgaagtacatccactcggccgggatcatccaccgggacctgaagcccagcaacgtggctgtgaacgaggactgtgagctcaggatcctggattttgggctggcgcgccaggcggacgaggagatgaccggctatgtggccacgcgctggtaccgggcacctgagatcatgctcaactggatgcattacaaccaaacagtggatatctggtccgtgggctgcatcatggctgagctgctccagggcaaggccctcttcccgggaagcgactacattgaccagctgaagcgcatcatggaagtggtgggcacacccagccctgaggttctggcaaaaatctcctcagaacacgcccggacatatatccagtccctgccccccatgccccagaaggacctgagcagcatcttccgtggagccaaccccctggccatagacctccttggaaggatgctggtgctggacagtgaccagagggtcagtgcagctgaggcactggcccacgcctacttcagccagtaccacgaccccgaggatgagccagaggccgagccatatgatgagagcgttgaggccaaggagcgcacgctggaggagtggaaggagctcacttaccaggaagtcctcagcttcaagcccccagagccaccgaagccacctggcagcctggagattgagcagtgaggtgctgcccagcagcccctgagagcctgtggaggggcttgggcctgcacccttccacagctggcctggtttcctcgagaggcacctcccacactcctatggtcacagacttctggcctaggacccctcgccttcaggagaatctacacgcatgatggagctgatccagtaacctcggagacgggaccctgcccagagctgagttgggggtgtggctctgccctggaaagggggtgacctcttgcctcgaggggcccagggaagcctgggtgtcaagtgcctgcaccaggggtgcacaataaagggggttctctct

SEQ ID NO: 2496 - DNA, 1408 bp, Homo sapiens
ggctcgggctcggctcgggcgcgggcgcggggcgcggggctgggcccgggcggagcggcggctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtacttggtgaccaccctgatgggcgccgacctgaacaacatcgtcaagtgccaggcgctgagcgacgagcacgttcaattcctggtttaccagctgctgcgcgggctgaagtacatccactcggccgggatcatccaccgggacctgaagcccagcaacgtggctgtgaacgaggactgtgagctcaggatcctggattttgggctggcgcgccaggcggacgaggagatgaccggctatgtggccacgcgctggtaccgggcacctgagatcatgctcaactggatgcattacaaccaaacaggtgcagggggaaggccttggggggacgaaggccaagggcctcgtctggccctcgactggctctgcatgccaggtcttagggggcaggcaaggtccccaagaatgtgggacccacattcaaaagtagcccttcagaggccgctagagcatgatgggtgctggcctcctctggctgtgcagctatggacctccccctgcctaggggggttgggtatggcagaggagggggtctgcccatcttggggtctggatgtgactgtgggtctcctggaggagggacgtggggtgggcacactgatggaggtcccctcgccctcgcacagtggatatctggtccgtgggctgcatcatggctgagctgctccagggcaaggccctcttcccgggaagcgactgtatccttggcccaggttggggagcagggtcaaacagggcccctcctgtagggtagggaccagcgctggccccttctggcgggtcttgcctcctctgccccccatgctatgctactttgggctggccatcctcacctataggagagcgggctctgggcagcgccccaaagttttgggtctgggggcccaggaggggtctgtggctggcccgtgggtgtttcctgagtgacacagacattgaccagctgaagcgcatcatggaagtggtgggcacacccagccctgaggttctggcaaaaatctcctcagaacacgtgagttggtgcccgccagccagcagctccctctcctggctgagcccccaggctctctgggggagagggtggtgtgg

SEQ ID NO: 2497 - DNA, 1918 bp, Homo sapiens
cggcggcggccgcctcgggtttccggaggggccggagggcgggcgagggcgtcacgtgcgcgccgcccgcgggccggttggtccccgggcgggggaggggccgtgcgcagcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccc

SEQ ID NO: 2498 - DNA, 1724 bp, Homo sapiens
gggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcctttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgagggacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtctgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaactacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccct

SEQ ID NO: 2499 - DNA, 2052 bp, Homo sapiens
cgtgcctgggccgcacctgccgcagtggctccgtcgggccgggcggaagcgcgggagcgcagggctggacaggcccgggcgtggcggccccggcgcacctgggcgagccggcaggtgggagcgtagcagcccggggcccccgccctcgcgcgggggaggagcgggcggcgcggggcgggcgcagcgggggtcggggcgctgggagcccgttgggccgcgaacgcagccgccacgctggggccgccgagatcgggtgcccgggatgagcctcatccggaaaaagggcttctacaagcaggacgtcaacaagacagcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatga

SEQ ID NO: 2500 - DNA, 1036 bp, Homo sapiens
cccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacaggccaaatcctacatccagtccctgccacagacccccaggaaggatttcactcagctgttcccacgggccagcccccagggtgagtctcagagcccgctccccaggggcctctcagcgtatcccagagggcgggctctcccagcccctggtgtgaggctcttggctctgcccctgcagctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcgtaagagctggggcctcgggcttcctcgcctccgcctgcagcctctcttccttgcttcctccatctttgtgcctggcctctgccagccctacctgccacctccttcttggtgggcattgtctcctgggtgcttctttctccttgagctgact

SEQ ID NO: 2501 - DNA, 1637 bp, Homo sapiens
cgtgcctgggccgcacctgccgcagtggctccgtcgggccgggcggaagcgcgggagcgcagggctggacaggcccgggcgtggcggccccggcgcacctgggcgagccggcaggtgggagcgtagcagcccggggcccccgccctcgcgcgggggaggagcgggcggcgcggggcgggcgcagcgggggtcggggcgctgggagcccgttgggccgcgaacgcagccgccacgctggggccgccgagatcgggtgcccgggatgagcctcatccggaaaaagggcttctacaagcaggacgtcaacaagacagcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaaggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgc

SEQ ID NO: 2502 - DNA, 1664 bp, Homo sapiens
gggcgctgggagcccgttgggccgcgaacgcagccgccacgctggggccgccgagatcgggtgcccgggatgagcctcatccggaaaaagggcttctacaagcaggacgtcaacaagacagcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacaggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactct

SEQ ID NO: 2503 - DNA, 1723 bp, Homo sapiens
gcggcgcggggcgggcgcagcgggggtcggggcgctgggagcccgttgggccgcgaacgcagccgccacgctggggccgccgagatcgggtgcccgggatgagcctcatccggaaaaagggcttctacaagcaggacgtcaacaagacagcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatga

SEQ ID NO: 2504 - DNA, 3779 bp, Homo sapiens
cgggaggctcccgtttgctggctcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaa

SEQ ID NO: 2505 - DNA, 4319 bp, Homo sapiens
atattgggtaaaatctcggctctcggagagtcccgggagctgttctcgcgagagtactgcgggaggctcccgtttgctggctcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattaaccagcttcagcagattatgcgtctgacaggaacaccccccgcttatctcattaacaggatgccaagccatgaggcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaatttagtgagtttctcaagtttattatatttttctcttgtttttatttaatgcacaatatggcattatatcaatatcctttaaactgtgacctggcatacttgtctgacagatcttaatactactcctaacatttagaaaatgttgataaagcttcttagttgtacattttttggtgaagagtatccaggtctttgctgtggatgggtaaagcaaagagcaaatgaacgaagtattaagcattggggcctgtcttatctacactcgagtgtaagagtggccgaaatgacagggctcagcagactgtggcctgagggccaaatctggcccaccacctgtttggtgtagcctgctaagaatggcttttacatttttaaatggttgggaaagaaaaaaaaagaagtagtagattttgtagcatgtgatgtaagtaatgtaaaacttaaattccagtatccataaataaagttttatgagaacaga

SEQ ID NO: 2506 - DNA, 1066 bp, Homo sapiens
atgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaac

SEQ ID NO: 2507 - DNA, 1376 bp, Homo sapiens
gtttgctggctcttggaaccgcgaccactggagccttagcgggcgcagcagctggaacgggagtactgcgacgcagcccggagtcggccttgtaggggcgaaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttaca

SEQ ID NO: 2508 - DNA, 1861 bp, Homo sapiens
ctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 2509 - DNA, 1743 bp, Homo sapiens
ctggcgcgcgcggccctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctggcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctg

SEQ ID NO: 2510 - DNA, 997 bp, Homo sapiens
cggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctgg

SEQ ID NO: 2511 - DNA, 1008 bp, Homo sapiens
atggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctggcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctag

SEQ ID NO: 2512 - DNA, 1978 bp, Homo sapiens
ctggcgcgcgcggccctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgaggtgggccagtccccagcagcagtggggctgggggcaggggagcaggggggcacgtaggcatcccccatgccaggcctgagccttgctgtctctaccaccccagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctg

SEQ ID NO: 2513 - DNA, 2567 bp, Homo sapiens
gagcgctttccgggacgtggagacgcggagcgtcccgaggaggcaggagactcgggatgatcgggagcgtcccagggagggggcccctgagtgctttctgggggagggggcgctgcctacgtcctcaggggagcaggcttggaggctttgagtccacccttctgtaatgatgggaggggcatccgagtgcatgtgggggcccgcggggaccctagtgacacggggcgaggcccagaggatgagtactctcggggaggcgacatccttagtgaagaggcagtggagggcccgttttgggggaaagggtgtcttggattccccctgtgaggcagtgccagggagcctgggggagaagagccgagatcagggtggggcagggctttggccccaccaccccaggggcccagagagagatgaggcggccaggagtgccacctgcatgttttgggaggggtctgtgagtgcccccggccccaccgtgtgctctgggcctctatccctctgggacagccccgctgcccggatccctcaccctgggaccctcccctgccctgtccattctctcctgcccctcccctggctgccaccttcccagtatttgccccatggtgtgtccccagcatctgcacccccggacctgtcttgggttaaggagcctttcctgggaatgggggcgaagggttcagggccagtagaatggaaggggattgaggagaggggaagtcagtgagcggtcagtctcttcctctgtttgtaaagtcaccgaagggccgcctggctggtccccagctttctctctggagatcccaggcctccacagcaggaaggaaccagcattgtttatgatttgaccagagccagctcctgctctctcccctccctgccaaggcctgggtggggccaccaggcccggactccccctttgtaaggccacagcagcagcctctctccggtcccctcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctg

SEQ ID NO: 2514 - DNA, 1402 bp, Homo sapiens
attaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttc

SEQ ID NO: 2515 - DNA, 739 bp, Homo sapiens
atgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacggaggaagaatgggaaaaggcatattcacaaggttacaataaggtgcctgtgagatataaaatttataactgccacatcctttcttaggaatttttaaatttctattttcttgtaatatgaata

SEQ ID NO: 2516 - DNA, 5628 bp, Homo sapiens
attgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgttgacatttggtcagttgggtgcatcatgggagaaatgatcaaaggtggtgttttgttcccaggtacagatcatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 2517 - DNA, 5637 bp, Homo sapiens
attaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgttgacatttggtcagttgggtgcatcatgggagaaatgatcaaaggtggtgttttgttcccaggtacagatcatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 2518 - DNA, 5638 bp, Homo sapiens
aattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 2519 - DNA, 5796 bp, Homo sapiens
gcggccgaggccggacgacgcggcttggattgcggagccgcgagcagcgctgggtaacggccgcggcgaccaccccggacggcccctgtccccgctggcgggcttccctgtcgccgttcgctgcgctgccggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatacttaacaaattatatcctaaaaacaaggtctctttgttaaatgttgcatgccctaggttttaaattactacatccaaatacagttttcgtcttaaatttgttaagctaaatatatgttggttctttttattttggaatcctttaagcatcttaaacattttttttttgaagagaagttacaaataacatttctatcaggtagtacttgtatgaaaccacctttcttattctataattttgatttttcaattttatatacttaatatactcactgtcttactatcagaaagttattttgaccaagatttttattatcttcatagattcagaaagagatgctaattctgtaccaatgtcttcctggttactattctcttccctctaatatatactggccatttgtaaaaccattgtgttgttgggatcacttagttatactatacgcagatagagcatctcaactctgtcatagtgtttgctgaacagttttcagtgtcatgcacctttggctgctaattgttcctgacgtgcactcttccgagttggtaaaggcacagtgtgttcatgccagacttctaagagaaacaccagcctcttaaatcagaagcctacacacaacccccttaacaatccaaagaagcttgatggtgtgcaaagaagcatcctgccagccttgtcattgttctgttctatgctaatcctgctgtgttgtctaaaagatggagggaagaggacatcagtgtctgatagtgaaatcatcagcaggaaagtgaagctctttccttggttacagataagacttggtttacactattggccagtatctgctaaacatatgaagacttaactattcagtgttgcctaggcattcgcctgcacaacattttgaggttagaacatagaatattttcagaaatactgttgtagtttgtgagtgttgttcattagttacacattagctatagagtggatgcatgaagccccatgacaccagtaaacttctcttaccagtaggtaaaccaaacaccattctgtcattagcagccctcttaaatgttgcctctccgtatcctgttgcatttttgtgtgcattgtgtttctactgatctctcttaggtttttacggaatcaaaggaaactaatttttccttaatagcaagaaagatgaagaggtaaagggcattgaagcagaaatgtatagtttggggtacgattagaaaactcgtaaggaaaacagaagtcctaatttcaaactgactgctcttcgttaagtgctcttaaggagagtctagtaacagtaacactttctggccatttctagtttagattctcttcgttactgaaacttttgagaaatattacctgtggattaattttgcacaatgttctattctcataatgacttacaaattaaactaggtttttattgaactacctcacactaattttctatgctttcccaagtaagctgttgccctgttagatctttactgagtgaattataaatgtgtgttaaatactttctagccaatgttgacacaataccagtaagtatgtaaagtatataccttacatcagtaagagacacgtgtaaaatctttgactgtatgtcttgcaaaattgtgctcgttgacattattactgtttttgtaagtagaaacctgctcgtgatatcggtccatttacattttacaaaaggagtaaatcttagtaaaaattttacgaagaaataaattacttttgtaggcccaatatttggtatatttttgagaagctgttaatcttttagctgaataatgaagttagactgaattacgtgtctccctggactgtgacatctattttctcattacagtttatcctggtcagcagggtgtcacacctggaaacctgagtatgatagctgacatttgcttttctccctctgcgatgtcattcctcctccattcctctccttccctgtgttccgttccctctcctttcctctagacaaaacaaaatggggcactttttagggaatgctgagatcattattgtggtttttcatcattcatgccctagtcattaaacatgcaccactggaatgtaaacaatgttatctagtatgtcaattggttataatattttaaataaaaaagaaaaaagtggtatgaaaattatgaaa

SEQ ID NO: 2520 - DNA, 927 bp, Homo sapiens
atgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtga

SEQ ID NO: 2521 - DNA, 860 bp, Homo sapiens
acctgggtgcgctccgctgcccgccagcccgcctgccgccgcgagccccgcccgcctgtcctctcgcgtcctcttcgcgtgggtcctgcctccgcggcgggagaagaaaatggagcggggggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcacctt

SEQ ID NO: 2522 - DNA, 603 bp, Homo sapiens
actcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttat

SEQ ID NO: 2523 - DNA, 907 bp, Homo sapiens
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttca

SEQ ID NO: 2524 - DNA, 2642 bp, Homo sapiens
gaggcaataggggcggagccgagtgggagtgtggaaagcgccgcatcccgggtgggaggcgaggcttccccttccccgcccctcccccggcctccagtccctcccagggccgcttcgcagagcggctaggagcacggcggcggcggcactttccccggcaggagctggagctgggctctggtgcgcgcgcggctgtgccgcccgagccggagggactggttggttgagagagagagaggaagggaatcccgggctgccgaaccgcacgttcagcccgctccgctcctgcagggcagcctttcggctctctgcgcgcgaagccgagtcccgggcgggtggggcgggggtccactgagaccgctaccggcccctcggcgctgacgggaccgcgcggggcgcacccgctgaaggcagccccggggcccgcggcccggacttggtcctgcgcagcgggcgcggggcagcgcagcgggaggaagcgagaggtgctgccctccccccggagttggaagcgcgttacccgggtccaaaatgcccaagaagaagccgacgcccatccagctgaacccggcccccgacggctctgcagttaacgggaccagctctgcggagaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacaaattttaggaaaagttagcattgctgtaataaaaggcctgacatatctgagggagaagcacaagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagcta

SEQ ID NO: 2525 - DNA, 1734 bp, Homo sapiens
cccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaa

SEQ ID NO: 2526 - DNA, 2039 bp, Homo sapiens
atgggagtgcaggggacattgatgtcaagggatcagacgcctcaccttctctccattctaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaatt

SEQ ID NO: 2527 - DNA, 2303 bp, Homo sapiens
agtcagcgcagttcggccggggtctccccggcgctgcccagtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaggactaaa

SEQ ID NO: 2528 - DNA, 2034 bp, Homo sapiens
aaagttctcagttggcccgtgtgaggagaaggccggggcagcggaggcttccggcggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaatt

SEQ ID NO: 2529 - DNA, 2171 bp, Homo sapiens
gcggccgcttccccccggccgggcccccgccgccccgcggtccccagagcgccaggcccccggggggagggagggagggcgccgggccggtgggagccagcggcgcgcggtgggacccacggagccccgcgacccgccgagcctggagccgggccgggtcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggggtgtcttcatgacaagaacagcgaccaggccacttggctgaccaggttgtgagcagaggattctgtgttcctgtccaaactcagtgctgtttcttagaatccttttattccctgggtctctaatgggaccttaaagaccatctggtatcatcttctcattttgcagaagagaaactgaggcccagaggcggagggcagtctgctcaaggtcacgcagctggtgactggttggggcagaccggacccaggtttcctgactcctggcccaagtctcttcctcctatcctgcgggatcactggggggctctcagggaacagcagcagtgccatagccaggctctctgctgcccagcgctggggtgaggctgccgttgtcagcgtggaccactaaccagcccgtcttctctctctgctcccacccctgccgccctcaccctgcccttgttgtctctgtctctcacgtctctcttctgctgtctctcctacctgtcttctggctctctctgtacccttcctggtgctgccgtgcccccaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattc

SEQ ID NO: 2530 - DNA, 2961 bp, Homo sapiens
gagccagcggcgcgcggtgggacccacggagccccgcgacccgccgagcctggagccgggccgggtcggggaagccggctccagcccggagcgaacttcgcagcccgtcggggggcggcggggagggggcccggagccggaggagggggcggccgcgggcacccccgcctgtgccccggcgtccccgggcaccatgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccaggggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagttga

SEQ ID NO: 2531 - DNA, 2500 bp, Homo sapiens
ctgcggccgccagctcccgcgaccgcctctcctgcccctcgccggtacctcagcaaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaaacctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccggtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcctggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcatt

SEQ ID NO: 2532 - DNA, 1160 bp, Homo sapiens
acgtgggcgccggcagcgcgactctcggccctgggatttctgcggccgccagctcccgcgaccgcctctcctgcccctcgccggtacctcagcaaggtgcgttgccgccaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaagg

SEQ ID NO: 2533 - DNA, 2988 bp, Homo sapiens
gggctgagcggtggggcccgggcggggtgcgcgggccccgtcgccgggtctggggccctgagcagtgaaaggaaatactttgacagatttccaagaactttccaggaaaacggggcggggccccgcgagctgaccaatcgcgacgctgaaggtggagccgagcggtcggggagggccaatagcagcgcgtggacccggggctgaagctacccagaggggcagggagtacttgctgcatttgatcctctacaactggtgttgctcccgttatgcggacagaagacagccccagggaacaaatgctaggaaatggcagggtgagaaaactgaggcatggagaggttacaatataacttagatctcccagctggcaagtaatggtttaagccaggagcctacacacttcctcctacttcctctatgggtgctggtgatctgccgactcctagacatccagctttaaggtcctcagtgaagcttctctgcccccaggcctgtccatgtcagagcaccatgggtgtccctttgaaagtatctcctacaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatgcatggaaggtggtgagttgttcagcaggattcaggagcgtggcgaccaggctttcactgagagagaagctgcagagataatgcgggatattggcactgccatccagtttctgcacagccataacattgcccaccgagatgtcaagcctgaaaacctactctacacatctaaggagaaagacgcagtgcttaagctcaccgattttggctttgctaaggagaccacccaaaatgccctgcagacaccctgctatactccctattatgtggcccctgaggtcctgggtccagagaagtatgacaagtcatgtgacatgtggtccctgggtgtcatcatgtacatcctcctttgtggcttcccacccttctactccaacacgggccaggccatctccccggggatgaagaggaggattcgcctgggccagtacggcttccccaatcctgagtggtcagaagtctctgaggatgccaagcagctgatccgcctcctgttgaagacagaccccacagagaggctgaccatcactcagttcatgaaccacccctggatcaaccaatcgatggtagtgccacagaccccactccacacggcccgagtgctgcaggaggacaaagaccactgggacgaagtcaaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaaacctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccggtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcctggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcattt

SEQ ID NO: 2534 - DNA, 535 bp, Homo sapiens
ctcaggccgttcgtcccgcactcccagcttgccccgggctcgcagcccagcccagttcagaggctccaaggctggggtgtgttggaaaagtctgggcgggactcactcttcccctttcccccaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatg

SEQ ID NO: 2535 - DNA, 2043 bp, Homo sapiens
gcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggtaaaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatcaaggactctgg

SEQ ID NO: 2536 - DNA, 2037 bp, Homo sapiens
gcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcagatagctttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatcaaggactctgg

SEQ ID NO: 2537 - DNA, 2527 bp, Homo sapiens
attagcgcagcgccatcgccgcggaaggcccaggggcctgtcctgtatgcggcgtgtcttagggaggcccaggcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcaggcaactttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatcaagg

SEQ ID NO: 2538 - DNA, 1825 bp, Homo sapiens
ccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggaaacttccattttagaagaatacagtatcaattggactcagaagctgggagctggaattagtggtccagttagagtctgtgtaaagaaatctactcaagaacggtttgcgctgaaaattcttcttgatcgtccaaaagctagaaatgaggtacgtctgcacatgatgtgtgccacacacccaaacatagttcagattattgaagtgtttgctaacagtgtccagtttccccatgagtccagccctagggcccgactcttaattgtaatggagatgatggaagggggagagctatttcacagaatcagccagcaccggcactttacagagaagcaagccagccaagtaacaaagcaggcaactttggctctgcggcactgtcacttgttaaacattgcgcacagagacctcaagcctgaaaatctgctttttaaggataactctttggatgccccagtgaagttgtgtgactttggatttgccaagattgaccaaggtgacttgatgacaccccagttcaccccttattatgtagcaccccaggtactggaggcgcaaagaaggcatcagaaggagaaatctggcatcatacctacctcaccgacgccctacacttacaacaagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagctcctgaaggtcaaaccggaggagagactcaccatcgagggagtgctggaccacccctggctcaattccaccgaggccctggataatgtgctgccttctgctcagctgatgatggacaaggcagtggttgcaggaatccagcaggctcacgcggaacagttggccaacatgagaatccaggatctgaaagtcagcctcaaacccctgcactcagtgaacaaccccattctgcggaagaggaagttacttggcaccaagccaaaggacagtgtctatatccacgaccatgagaatggagccgaggattccaatgttgccttggaaaaactccgagatgtgattgctcagtgtattctcccccaggctggtaaaggagagaatgaagatgagaaactgaatgaagtaatgcaggaggcttggaagtataaccgggaatgcaaactcctaagagatactctgcagagcttcagctggaatggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgcc

SEQ ID NO: 2539 - DNA, 3165 bp, Homo sapiens
atggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggt

SEQ ID NO: 2540 - DNA, 3465 bp, Homo sapiens
agttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgcacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggt

SEQ ID NO: 2541 - DNA, 3348 bp, Homo sapiens
agttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggtaacagatggctcctcagggcagaggcggctgattgcactgcttatggcctttgtctgctccctgcctcgaaatggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggt

SEQ ID NO: 2542 - DNA, 3348 bp, Homo sapiens; identical to SEQ ID NO: 2541

SEQ ID NO: 2543 - DNA, 3174 bp, Homo sapiens
acggtctctagttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaaggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaat

SEQ ID NO: 2544 - DNA, 3530 bp, Homo sapiens
atgtgaccgacagcaccgccccctagggctgggcctgattttctcattggcttcccccgtgttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 2545 - DNA, 3396 bp, Homo sapiens
atggccgctgccgcggctgtggaggcggcggcgcctatgggtgccctatggggcctcgtgcacgacttcgtcgtgggtcagcaagagggccccgctgaccaggtggctgcgtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggt

SEQ ID NO: 2546 - DNA, 3797 bp, Homo sapiens
gattttctcattggcttcccccgtggtgcgtaccgcccctctccccacccagccaggtgcccgccccgcagcccgtctcccggggagccgggctgggaattattcgccctcaatcgcctccggctgcgtgcccagcagccgccttccctctcggtgccaccgccccatttcaggccccgcccctccctggaactgcctaggcagaagccggcaggcacgtgaccccggcgccccgcccccttgcgcttccccggagattggctcgggaggcgcatgcgcggagagcccgtctcgagccaccgcccatatcccctcccacggtctctagttcgcgttatggccgctgccgcggctgtggaggcggcggcgcctatgggtgccctatggggcctcgtgcacgacttcgtcgtgggtcagcaagagggccccgctgaccaggtggctgcagatgtgaaatctggcaactatacagtgttacaagttgtggaagcccttgggtcctctctagagaatccagaaccccgaactcgggcacgagcaatccagcttttgtcacaggtgctactccactgtcacaccttgctcctggagaaggaagtggtacacctgatactgttctatgagaaccggctgaaggaccatcatcttgtgatcccatctgtcctgcagggtttgaaggcacttagcctgtgtgtggccctgcccccagggctggctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagaggtgttccagacggcaagtgagcgggtggaggcagagggcctggcggccctccactccctgactgcgtgtttgtctcgctctgtgctgagggctgatgctgaggacctccttgactccttccttagcaacattctacaggactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggatggctcctcagggcagaggcggctgattgcactgcttatggcctttgtctgctccctgcctcgaaatgtggaaatccctcagctgaaccaactcatgcgggagcttttggaactgagctgctgccacagctgccccttttcttccaccgctgctgccaagtgctttgcaggactcctcaacaagcaccctgcagggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaagatgtgaagccaaactacttgaagggtctttctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggctgtccggatcgccgcactgcagtgcatgcatgctctcactcgcctgcccacccctgtgctgctgccgtacaaaccacaggtgattcgggccttagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaa

SEQ ID NO: 2547 - DNA, 3942 bp, Homo sapiens
gggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagactt

SEQ ID NO: 2548 - DNA, 2723 bp, Homo sapiens
gggcggggcgcaggagccccggggcggaggagccggggaggcgggaggcgggaggcgggaggtgttggggccgttgaagcggcctccctcccgcccccagccgcccggtctggccccagccctgtcccgacccccggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggttcatgaaccatcgagctccagccaatggccgctacaagccaacttgctatgaacatgctgctaactgttacacacacgcattcctcattgttccggccatcgtgggcagtgccctcctccatcggctgtctgatgactgctgggaaaagataacagcatggatttatggaatgggactctgtgccctcttcatcgtttctacagtatttcacattgtatcatggaaaaagagccacttaaggacagtggagcattgttttcacatgtgtgatagaatggttatctatttcttcattgctgcttcttatgctccatggttaaatcttcgtgaacttggacccctggcatctcatatgcgttggtttatctggctcatggcagctggaggaaccatttatgtatttctctaccatgaaaaatataaggtggttgaactctttttctatctcacaatgggattctctccagccttggtggtgacatcaatgaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcaaaagatccaactttttctctatgcctttgccacattctcttcagggtctctttccacagtggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcctttgcatcttctcatatattgtgtttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtcaaaaccactaatatgtatgtaaaaattgtgctgtatactacaataaagttgttacttggatttgttcca

SEQ ID NO: 2549 - DNA, 2746 bp, Homo sapiens
agccaatgagagccgaactggacttgaagcatctacgttatccatgaagtgtcgcgagagaaacggacgccgttctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcagacactggtctggagacttctacccgtagcaggaactcaaagactgctgtgtcagcatctagaaatatgtctattatagatgcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaa

SEQ ID NO: 2550 - DNA, 2588 bp, Homo sapiens
acgttatccatgaagtgtcgcgagagaaacggacgccgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtgggaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttcta

SEQ ID NO: 2551 - DNA, 2604 bp, Homo sapiens
aaacggacgccgttctctcccgcggaattcaggtttacggccctgcgggttctcagaggcaagttcagaccgtgttgttttcttttcacggatcctgccctttcttcccgaaaagaagacagccttggaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagacactggtctggagacttctacccgtagcaggaactcaaagactgctgtgtcagcatctagaaatatgtctattatagatgcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttc

SEQ ID NO: 2552 - DNA, 2684 bp, Homo sapiens
gacgccgttctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcactgtaagcacctgacttctggaatcccttgttatttggggtttctaaagctcgtcaactgtgatcacagtaaaagaaaacttatttaataagcagtaaataaggaacctgtttatgaacagaaatattagtcatcaaaaaggtgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcagacactggtctggagacttctacccgtagcaggaactcaaagactgctgtgtcagcatctagaaatatgtctattatagatgcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatg

SEQ ID NO: 2553 - DNA, 572 bp, Homo sapiens
ttgaagcatctacgttatccatgaagtgtcgcgagagaaacggacgccgttctctcccgcggaattcaggtttacggccctgcgggttctcagagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggc

SEQ ID NO: 2554 - DNA, 558 bp, Homo sapiens
acggccctgcgggttctcagaggcaagttcagaccgtgttgttttcttttcacggatcctgccctttcttcccgaaaagaagacagccttgggtcgcgattgtggggcttcgaagagtccagcagtgggaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactat

SEQ ID NO: 2555 - DNA, 1212 bp, Homo sapiens
ctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacagggtataggattgattgaaaagaagacagacttgaagaagcaagatttattatctgatcactgcagtaaaaatgtgaggtggtgacagtgatggcaatgaaacagaaatgggagggacacaccggagaagttgtcagggaagaactcaaaggatttggggcctgattatataatttattacagttgtcccttggtatccacggggggtgttcggtccaggacctaaaatcctgggatgctgaaatcccttgaataaaatggtatagcatttgcatataacctacatatatcctcctatgtactttaaatcatctctagattacttgtaatacctgatacaatgtaaatactgtttaaatagttgttatactgtattgctttaaaaatttatatttttcgttgtta

SEQ ID NO: 2556 - DNA, 859 bp, Homo sapiens
cctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 2557 - DNA, 1050 bp, Homo sapiens
acctctcaagcagccagcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgctttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgcc

SEQ ID NO: 2558 - DNA, 537 bp, Homo sapiens
ctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgcttctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 2559 - DNA, 648 bp, Homo sapiens
ctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctatcccagcaccgactactaccaagagctgcagagagacatttctgaaatgtttttgcagatttataaacaagggggttttctgggcctctccaatattaagttcagtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 2560 - DNA, 543 bp, Homo sapiens
ctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctttgtctactggggtctctttctttttcctgtcttttcacatttcaaacctccagtttaattcctctctggaagatcccagcaccgactactaccaagagctgcagagagacatttctgaaatggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 2561 - DNA, 804 bp, Homo sapiens
ctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 2562 - DNA, 1032 bp, Homo sapiens
gcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtggg

SEQ ID NO: 2563 - DNA, 937 bp, Homo sapiens
gcgcctgcctgaatctgttctgccccctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtggg

SEQ ID NO: 2564 - DNA, 1811 bp, Homo sapiens
cgctccacctctcaagcagccagcgcctgcctgaatctgttctgccccctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtgggcccctgagggctcatgcctgggaagtgttgtggtgggggctcccaggaggactggcccagagagccctgagatagcggggatcctgaactggactgaataaaacgtggtctcccactgcgccaa

SEQ ID NO: 2565 - DNA, 516 bp, Homo sapiens
ctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 2566 - DNA, 729 bp, Homo sapiens
ctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctatcccagcaccgactactaccaagagctgcagagagacatttctgaaatggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcc

SEQ ID NO: 2567 - DNA, 1923 bp, Homo sapiens
acctctcaagcagccagcgcctgcctgaatctgttctgccccctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcccccccagcccacggtgtcacctcggccccggacaccaggccggccccgggctccaccgcacccccagcccacggtgtcacctcggccccggacaccaggcgggccccgggctccaccccggccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtg

SEQ ID NO: 2568 - DNA, 927 bp, Homo sapiens
gcgcctgcctgaatctgttctgccccctccccacccatttcaccaccaccatgacaccgggcacccagtctcctttcttcctgctgctgctcctcacagtgcttacagttgttacgggttctggtcatgcaagctctaccccaggtggagaaaaggagacttcggctacccagagaagttcagtgcccagctctactgagaagaatgctatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtggg

SEQ ID NO: 2569 - DNA, 1194 bp, Homo sapiens
gcgcctgcctgaatctgttctgccccctccccacccatttcaccaccaccatgacaccgggcacccagtctcctttcttcctgctgctgctcctcacagtgcttacagctaccacagcccctaaacccgcaacagttgttacgggttctggtcatgcaagctctaccccaggtggagaaaaggagacttcggctacccagagaagttcagtgcccagctctactgagaagaatgcttttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaagaggcaaaatgggtggagcactatgcccaggggagcccttcccgaggagtcccaggggtgagcctctgtgcccctaatcatctcctaggaatggagggtagaccgagaaaggctggcatagggggaggtttcccaggtagaagaagaagtgtcagcagaccaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacagcctccttcagaggccccaccaatttctcggacacttctcagtgtgtggaagctcatgtggg

SEQ ID NO: 2570 - DNA, 2761 bp, Homo sapiens
ggtgtccggagccgcggacctagagatcccagaagccacagcgcagcggcccggcccgccactatttccaggctcagcggggcaggggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaa

SEQ ID NO: 2571 - DNA, 3148 bp, Homo sapiens
caatccctgagtatctcgggaaggaggtgtccggagccgcggacctagagatcccagaagccacagcgcagcggcccggcccgccactatttccaggctcagcggggcaggggtgggcccagactccacttcccggcgggtagtgcgaccctaggggcgggacttcatgtcccagcaggctccgggcggcgtgcgccgcggtgcctagtgtgggatgtaagcgcggaggtgggcgagggggaccgaggccaggactctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaa

SEQ ID NO: 2572 - DNA, 3162 bp, Homo sapiens
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagagtaggcatctttatatgttaacagacactgatacccagctaaagcggctgaacacatttactctctggcagtgtttaaaagtatctgtttttctcatattgttttattttaattttttctggatcaagcaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgtt

SEQ ID NO: 2573 - DNA, 1871 bp, Homo sapiens
gccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctga

SEQ ID NO: 2574 - DNA, 2862 bp, Homo sapiens
ctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggtgagcagaggctgaagagggtggggaagcaggggagctgtgcgtgtgtcggggcgggtggaaccttagcggaccctgggaggaggctccccggccgaacctgcccgaccctccctcccccggcttgccttgcaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaa

SEQ ID NO: 2575 - DNA, 2614 bp, Homo sapiens
gggcggcgtgcgccgcggtgcctagtgtgggatgtaagcgcggaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaa

SEQ ID NO: 2576 - DNA, 3150 bp, Homo sapiens
cggcgggtagtgcgaccctaggggcgggacttcatgtcccagcaggctccgggcggcgtgcgccgcggtgcctagtgtgggatgtaagcgcggaggtgggcgagggggaccgaggccaggactctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggtgagcagaggctgaagagggtggggaagcaggggagctgtgcgtgtgtcggggcgggtggaaccttagcggaccctgggaggaggctccccggccgaacctgcccgaccctccctcccccggcttgccttgcaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaa

SEQ ID NO: 2577 - DNA, 3155 bp, Homo sapiens
caatccctgagtatctcgggaaggaggtgtccggagccgcggacctagagatcccagaagccacagcgcagcggcccggcccgccactatttccaggctcagcggggcaggggtgggcccagactccacttcccggcgggtagtgcgaccctaggggcgggacttcatgtcccagcaggctccgggcggcgtgcgccgcggtgcctagtgtgggatgtaagcgcggaggtgggcgagggggaccgaggccaggactctccttggggtttgggggcttgacctgggtgcgctttctggacagactttacagccccgggggcacagtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgtt

SEQ ID NO: 2578 - DNA, 3034 bp, Homo sapiens
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagacaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgtt

SEQ ID NO: 2579 - DNA, 870 bp, Homo sapiens
gcgcggaggtgggcgagggggaccgaggccaggactctccttggggtttgggggcttgacctgggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcag

SEQ ID NO: 2580 - DNA, 816 bp, Homo sapiens
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagacaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcat

SEQ ID NO: 2581 - DNA, 944 bp, Homo sapiens
tatatttatgtatatgcacatacacacaaaattaggcgggagtggtggcgcacgcctgtgatcacagctactcgggaggctgaggcacgagaatcgcttgagcccgtgaagtcgaggctgcagtgagcccagatcgagccactgcattccagcctgggcgaaagagaaagaccgtgtctcaaaacaaacaaacaaaagctactcttagcacgtgttagagtatctcgcgggcggaagtgggaaacgagtgctgcacacagagtaggcatctttatatgttaacagacactgatacccagctaaagcggctgaacacatttactctctggcagtgtttaaaagtatctgtttttctcatattgttttattttaattttttctggatcaagcaacctgatctttttcctcataacttgccgaccgacccgtgacagcaaaaccggcagaagctcggcgacctcccaccccgagtctgcaggtagccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcat

SEQ ID NO: 2582 - DNA, 1107 bp, Homo sapiens
gggcggcgtgcgccgcggtgcctagtgtgggatgtaagcgcggaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactg

SEQ ID NO: 2583 - DNA, 2768 bp, Homo sapiens
ggtgtccggagccgcggacctagagatcccagaagccacagcgcagcggcccggcccgccactatttccaggctcagcggggcaggggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcatgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgtt

SEQ ID NO: 2584 - DNA, 922 bp, Homo sapiens
gacttcatgtcccagcaggctccgggcggcgtgcgccgcggtgcctagtgtgggatgccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttaggg

SEQ ID NO: 2585 - DNA, 2392 bp, Homo sapiens
acaaagaccccgctctcgaatctggggtgacaggaaggagccggtccaggctccgggggctgggaaagggcgcgtctcaaaggctggctggagtggagccaagggaaaagatcgttagagacagcgcccctgaccaaccacttagagcagcgcaggggtgggagggcggccgcaggctctcctctcgttagtgccccctgtgtttggggccccgtgatctcaacggtcctgccctcggtctccctcttcccccgccccgccctgggccaggtgttcgaatcccgactccagaactggcggcgtcccagtcccgcgggcgtggagcgccggaggacccgccctcgggctcatggcggccccggtccgcctgggccggaagcgcccgctgcctgcctgtcccaacccgctcttcgttcgctggctgaccgagtggcgggacgaggcgacccgcagcaggcgccgcacgcgcttcgtatttcagaaggcgctgcgttccctccgacggtacccactgccgctgcgcagcgggaaggaagctaagatcctacagcacttcggagacgggctctgccggatgctggacgagcggctgcagcggcaccgaacatcgggcggtgaccatgccccggactcaccatctggagagaacagtccagccccgcaggggcgacttgcggaagtccaggactcttccatgccagttcctgcccagcccaaagcgggaggctctggcagctactggccagctcggcactcaggagcccgagtgatactgctggtgctctaccgggagcacctgaatcctaatggtcaccacttcttaaccaaggaggagctgctgcagaggtgtgctcagaagtcccccagggtagcccctgggagtgctcgaccctggccagccctccgctccctccttcacaggaacctggtcctcaggacacaccagccagccaggtactcattgaccccagagggcctggagctggcccagaagttggccgagtcagaaggcctgagcttgctgaatgtgggcatcgggcccaaggagccccctggggaggagacagcagtgccaggagcagcttcagcagagcttgccagtgaagcaggggtccagcagcagccactggagctgaggcctggagagtacagggtgctgttgtgtgtggacattggcgagacccgggggggcgggcacaggccggagctgctccgagagctacagcggctgcacgtgacccacacggtgcgcaagctgcacgttggagattttgtgtgggtggcccaggagaccaatcctagagacccagcaaaccctggggagttggtactggatcacattgtggagcgcaagcgactggatgacctttgcagcagcatcatcgacggccgcttccgggagcagaagttccggctgaagcgctgtggtctggagcgccgggtatacctggtggaagagcatggttccgtccacaacctcagccttcctgagagcacactgctgcaggctgtcaccaacactcaggtcattgatggcttttttgtgaagcgcacagcagacattaaggagtcagccgcctacctggccctcttgacgcggggcctgcagagactctaccagggccacaccctacgcagccgcccctggggaacccctgggaaccctgaatcaggggccatgacctctccaaaccctctctgctcactcctcaccttcagtgacttcaacgcaggagccatcaagaataaggcccagtcggtgcgagaagtgtttgcccggcagctgatgcaggtgcgcggagtgagtggggagaaggcagcagccctggtggatcgatacagcacccctgccagcctcctggccgcctatgatgcctgtgccacccccaaggaacaagagacactgctgagcaccattaagtgtgggcgtctacagaggaatctggggcctgctctgagcaggaccttatcccagctctactgcagctacggccccttgacctgagcttatgccgtgaaacagcccccagcccccgtctgtcccccaacccaggctagccagccttttaacaacatcttttggggtacaattagaatctaagtgtttgcagccatatgtgtcatgtagaagatgcctagccctggggaccttgtgaaatacgcaggaaccagggataccatctggtccagtggtttttaaacaaagctgcttagcacctggaattccctggtcagggagatggagtcagtggggcattgcagcttggaatctattttatgtcaccagttggtcctcatcaaataaaatttccttaggagtgcagagggctcattgggaaaataaaaataataaaaataaataaaacttcctaaaagaaaagattgaaaacca

SEQ ID NO: 2586 - DNA, 2358 bp, Homo sapiens
aaagaccccgctctcgaatctggggtgacaggaaggagccggtccaggctccgggggctgggaaagggcgcgtctcaaaggctggctggagtggagccaagggaaaagatcgttagagacagcgcccctgaccaaccacttagagcagcgcaggggtgggagggcggccgcaggctctcctctcgttagtgccccctgtgtttggggccccgtgatctcaacggtcctgccctcggtctccctcttcccccgccccgccctgggcggcgtcccagtcccgcgggcgtggagcgccggaggacccgccctcgggctcatggcggccccggtccgcctgggccggaagcgcccgctgcctgcctgtcccaacccgctcttcgttcgctggctgaccgagtggcgggacgaggcgacccgcagcaggcgccgcacgcgcttcgtatttcagaaggcgctgcgttccctccgacggtacccactgccgctgcgcagcgggaaggaagctaagatcctacagcacttcggagacgggctctgccggatgctggacgagcggctgcagcggcaccgaacatcgggcggtgaccatgccccggactcaccatctggagagaacagtccagccccgcaggggcgacttgcggaagtccaggactcttccatgccagttcctgcccagcccaaagcgggaggctctggcagctactggccagctcggcactcaggagcccgagtgatactgctggtgctctaccgggagcacctgaatcctaatggtcaccacttcttaaccaaggaggagctgctgcagaggtgtgctcagaagtcccccagggtagcccctgggagtgctcgaccctggccagccctccgctccctccttcacaggaacctggtcctcaggacacaccagccagccaggtactcattgaccccagagggcctggagctggcccagaagttggccgagtcagaaggcctgagcttgctgaatgtgggcatcgggcccaaggagccccctggggaggagacagcagtgccaggagcagcttcagcagagcttgccagtgaagcaggggtccagcagcagccactggagctgaggcctggagagtacagggtgctgttgtgtgtggacattggcgagacccgggggggcgggcacaggccggagctgctccgagagctacagcggctgcacgtgacccacacggtgcgcaagctgcacgttggagattttgtgtgggtggcccaggagaccaatcctagagacccagcaaaccctggggagttggtactggatcacattgtggagcgcaagcgactggatgacctttgcagcagcatcatcgacggccgcttccgggagcagaagttccggctgaagcgctgtggtctggagcgccgggtatacctggtggaagagcatggttccgtccacaacctcagccttcctgagagcacactgctgcaggctgtcaccaacactcaggtcattgatggcttttttgtgaagcgcacagcagacattaaggagtcagccgcctacctggccctcttgacgcggggcctgcagagactctaccagggccacaccctacgcagccgcccctggggaacccctgggaaccctgaatcaggggccatgacctctccaaaccctctctgctcactcctcaccttcagtgacttcaacgcaggagccatcaagaataaggcccagtcggtgcgagaagtgtttgcccggcagctgatgcaggtgcgcggagtgagtggggagaaggcagcagccctggtggatcgatacagcacccctgccagcctcctggccgcctatgatgcctgtgccacccccaaggaacaagagacactgctgagcaccattaagtgtgggcgtctacagaggaatctggggcctgctctgagcaggaccttatcccagctctactgcagctacggccccttgacctgagcttatgccgtgaaacagcccccagcccccgtctgtcccccaacccaggctagccagccttttaacaacatcttttggggtacaattagaatctaagtgtttgcagccatatgtgtcatgtagaagatgcctagccctggggaccttgtgaaatacgcaggaaccagggataccatctggtccagtggtttttaaacaaagctgcttagcacctggaattccctggtcagggagatggagtcagtggggcattgcagcttggaatctattttatgtcaccagttggtcctcatcaaataaaatttccttaggagtgcagagggctcattgggaaaataaaaataataaaaataaataaaacttcctaaaagaaaagattgaaaacc

SEQ ID NO: 2587 - DNA, 8257 bp, Homo sapiens
agaaaccacttacaactccagacgattcgaaggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacacttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaagcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggagggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgccgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggagtgtgctgatgctgcctccccagctctgtccctagccgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggcgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcatttggtcaaagttagttcctgtgattttttttttttttttttgagatggagttttgctcgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttctctgagaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactaaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtctttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcaggaaaacatacagcaaattttcttatccagtgggaacagcctatttgacaaggaatgatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatgtaaaaccacatccttgactagtacttcatctttccacagtcatccatctgctaatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaaaatagctactttgcgttatttgatatagaattgttttttaaaaactccatttatttatacagagacatttataatattttacaaacattcttatattctgaataaatatttctaattccacagtgta

SEQ ID NO: 2588 - DNA, 2752 bp, Homo sapiens
gccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataatttcttatttaattttattatgtatatattgtgtcagttcagatgccaaaaagaggtcttgaacatgtcaca

SEQ ID NO: 2589 - DNA, 2251 bp, Homo sapiens
aaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtctt

SEQ ID NO: 2590 - DNA, 2024 bp, Homo sapiens
aaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtctt

SEQ ID NO: 2591 - DNA, 2085 bp, Homo sapiens
aaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagccttggcacagcatcaaaccaagttataccttctcaacaccaccaagtttcagtgaagaactgttctaccagatactcatttatgattttgccaattttggtgttctcaggttatcgagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtctt

SEQ ID NO: 2592 - DNA, 2428 bp, Homo sapiens
gacgtgccagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacat

SEQ ID NO: 2593 - DNA, 2089 bp, Homo sapiens
aaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtctt

SEQ ID NO: 2594 - DNA, 2296 bp, Homo sapiens
ttccctgacgtgccagtcaggccttctccttttccgcagaccgtgtgtttctttaccgctctcccccgagaccttttaagggttgtttggagtatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgata

SEQ ID NO: 2595 - DNA, 2230 bp, Homo sapiens
ggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacat

SEQ ID NO: 2596 - DNA, 2608 bp, Homo sapiens
cacaacggcggaggccgccgggttccctgacgtgccagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaacaatatacgcaaagactattaaatggaagcatacctgacatgttaaaggactatcaaggaggccagtttgtctagaggctgaaaaggaaagagtaataggagatgaggtctgagtgaaaacacgtaaatccttgtgggccaagaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 2597 - DNA, 2303 bp, Homo sapiens
ctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagtgacccagatgctgatttcccaaggtcaaggatgtctgaagacaatgtgccaatgtgcccagattcttctagttaaggatctacttgagtctcagcccttatgctgtttttgttttccaagctgggatatgaaaaagcagaaaacccaatagggtaacattaatccaagtcaacatagcaaccagtatcttacctaatggcccttctcctgctgactccaagacctgagcagcttcctgagacacaacagtgatggctccagccactggttca

SEQ ID NO: 2598 - DNA, 2306 bp, Homo sapiens
aaaatgtcgttcgtggcaggggttattcggcggctggacgagacagtggtgaaccgcatcgcggcgggggaagttatccagcggccagctaatgctatcaaagagatgattgagaactgtttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtggaggaccttttttacaacatagccacgaggagaaaagctttaaaaaatccaagtgaagaatatgggaaaattttggaagttgttggcaggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtctt

SEQ ID NO: 2599 - DNA, 2366 bp, Homo sapiens
acaacggcggaggccgccgggttccctgacgtgccagtcaggccttctccttttccgcagaccgtgtgtttctttaccgctctcccccgagaccttttaagggttgtttggagttttagatgcaaaatccacaagtattcaagtgattgttaaagagggaggcctgaagttgattcagatccaagacaatggcaccgggatcaggaaagaagatctggatattgtatgtgaaaggttcactactagtaaactgcagtcctttgaggatttagccagtatttctacctatggctttcgaggtgaggctttggccagcataagccatgtggctcatgttactattacaacgaaaacagctgatggaaagtgtgcatacagagcaagttactcagatggaaaactgaaagcccctcctaaaccatgtgctggcaatcaagggacccagatcacggtattcagtacacaatgcaggcattagtttctcagttaaaaaacaaggagagacagtagctgatgttaggacactacccaatgcctcaaccgtggacaatattcgctccatctttggaaatgctgttagtcgagaactgatagaaattggatgtgaggataaaaccctagccttcaaaatgaatggttacatatccaatgcaaactactcagtgaagaagtgcatcttcttactcttcatcaaccatcgtctggtagaatcaacttccttgagaaaagccatagaaacagtgtatgcagcctatttgcccaaaaacacacacccattcctgtacctcagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgaggttctccgggagatgttgcataaccactccttcgtgggctgtgtgaatcctcagtgggccttggcacagcatcaaaccaagttataccttctcaacaccaccaagcttagtgaagaactgttctaccagatactcatttatgattttgccaattttggtgttctcaggttatcggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggaagggaacctgattggattaccccttctgattgacaactatgtgccccctttggagggactgcctatcttcattcttcgactagccactgaggtgaattgggacgaagaaaaggaatgttttgaaagcctcagtaaagaatgcgctatgttctattccatccggaagcagtacatatctgaggagtcgaccctctcaggccagcagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaac

SEQ ID NO: 2600 - DNA, 5233 bp, Homo sapiens
aacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcagattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatga

SEQ ID NO: 2601 - DNA, 7896 bp, Homo sapiens
aacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcctttttccttc

SEQ ID NO: 2602 - DNA, 7872 bp, Homo sapiens
aacaactggtgcgcatgcgcactggtgtctcgcggcctggcgcgccccctccgaagcgcatgctcgtgggcacgcacgagcctcaagatccaaggtgcgcgcgtcggcgtccgaggcggttggtgtcggagaatttgttaagcgggactccaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgactgaatcagcccagtgtccctgagcagcttagacagcagggctctctgtatcagtctttcttgagcagatgattcccctagttgagtagccagatgaaattcaagcctaaagacaattcattcatttgcatccatgggcacagaaggttgctatatagtatctaccttttgctacttatttaatgataaaatttaatgacagtttgattggttgcttggtttgttatttgaagggtgtgatttttgtttttgtacagttttttttcaagcttcacatttgcgtgtatctaattcagctgatgctcaagtccaaggggtagtctgccttcccaggctgcccccagggtttctgcactggtcccctcttttcccttcagtcttcttcacttccctatgctgctgcttcatgtgctacatctcagacttaaagagtttctctactacagtgaaaacattctctagggtctttcatcaggcctttagttattttagggataaaaactattgataaaaaggacaaggatagaacagagaaaatttaaagtcctgttccgggttttttgttatgttttctttaaaaactcagagactgatgttcaatatcccaaaccagtaaaatggtgaaaatactatgagcttgttttttaaaatatgattttttttggtactttataaagtatctctttatgtgaaagcaattgtcatatcaaaacacagcatacatacgttcaacctaaccaaatatctttacactttttctttcaggagacaagggttctttgggtccctttcaaacggtatcttggtgttattacattatgcctatctattgcccttataatatcacttgggaccaggactgatcgttctgcaaatgcttgttatgccattctcaatctatttttcccgcaccttttcacatgatttgtggttaataggactcaacagactaaaattgcatagtagaaaaaaaatgcaaaaagccagctggtaatgtttattgcaactggggtgctatacaattagtaagatgatgcaatgagaatttctacttttgtatttcctgaccagcctgctcaaagtggcttttatatcaattgaatgattttcctcattttttaatacaggaaaccaattcgtgctcatggaagaaaagttcctttgccagcagccttgaagtgaatcttacaggagcaatgaaagtattgcattcattagcgtctgccccagagaaggttcagagaaaaccttcacttgttttcaaggggatccttgtagatttacgtaattggaatcctgaagaacaggccctactgtctaaaaaatggcttttattcttctaaatacatataaacggatgttttatagatgggaagacatgaccttagaaaggagagagttttcagaggatttgccaggctgtcaggggctctgcctccaggcccagtgtggcagtgtggcctcagggcctccgcctccctgcttgagggctgcatggaggccaactgtcctgggagttgtaaaaatcttttaaggccagaccaatttgagggattttaaaaagtgtctcagtgcctcttatgatttcagaaggttttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaatatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctgtaacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtatgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcctttttccttc

SEQ ID NO: 2603 - DNA, 1119 bp, Homo sapiens
atgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttctccagcaagtagataacaagtttattgcctgtttgatgagcactaagactgaagagaatggcgaggcagctgagttgatgatgttgcaggacccgtgttgcaggcagagcagagaggatgaaaatcatgagttcagtctttgaaatgctccagaagagatgtcaaggtggccaggcacggtggctcacgcctgtaatcccagcactttgggaggccgaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccat

SEQ ID NO: 2604 - DNA, 616 bp, Homo sapiens
ctcgcggcctggcgcgccccctccgaagcgcatgctcgtgggcacgcacgagcctcaagatccaaggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatgg

SEQ ID NO: 2605 - DNA, 4491 bp, Homo sapiens
ccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctgtggaaatttcgtccaagaaaaacaggacaatgaaaacttttgtgaaactgtttcagagtggaaaagccctgaaagcttgtgaagctgatgtgactagagcaagcgctgggactactgtaacagtgtataacctattttaccagcttcctgtaaggaggaaatgcatggaccctagactggagtttgagaaggttaggcagagaatagaagctctctcactcatgcacccttccatttctttctctttgagaaatgatgtttctggttccatggttcttcagctccctaaaaccaaagacgtatgttcccgattttgtcaaatttatggattgggaaagtcccaaaagctaagagaaataagttttaaatataaagagtttgagcttagtggctatatcagctctgaagcacattacaacaagaatatgcagtttttgtttgtgaacaaaagactagttttaaggacaaagctacataaactcattgactttttattaaggaaagaaagtattatatgcaagccaaagaatggtcccaccagtaggcaaatgaattcaagtcttcggcaccggtctaccccagaactctatggcatatatgtaattaatgtgcagtgccaattctgtgagtatgatgtgtgcatggagccagccaaaactctgattgaatttcagaactgggacactctcttgttttgcattcaggaaggagtgaaaatgtttttaaagcaagaaaaattatttgtggaattatcaggtgaggatattaaggaatttagtgaagataatggttttagtttatttgatgctactcttcagaagcgtgtgacttccgatgagaggagcaatttccaggaagcatgtaataatattttagattcctatgagatgtttaatttgcagtcaaaagctgtgaaaagaaaaactactgcagaaaacgtaaacacacagagttctagggattcagaagctaccagaaaaaatacaaatgatgcatttttgtacatttatgaatcaggtggtccaggccatagcaaaatgacagagccatctttacaaaacaaagacagctcttgctcagaatcaaagatgttagaacaagagacaattgtagcatcagaagctggagaaaatgagaaacataaaaaatctttcctggaacatagctctttagaaaatccgtgtggaaccagtttagaaatgtttttaagcccttttcagacaccatgtcactttgaggagagtgggcaggatctagaaatatggaaagaaagtactactgttaatggcatggctgccaacatcttgaaaaataatagaattcagaatcaaccaaagagatttaaagatgctactgaagtgggatgccagcctctgccttttgcaacaacattatggggagtacatagtgctcagacagagaaagagaaaaaaaaagaatctagcaattgtggaagaagaaatgtttttagttatgggcgagttaaattatgttccactggctttataactcatgtagtacaaaatgaaaaaactaaatcaactgaaacagaacattcatttaaaaattatgttagacctggtcccacacgtgcccaagaaacatttggaaatagaacacgtcattcagttgaaactccagacatcaaagatttagccagcactttaagtaaagaatctggtcaattgcccaacaaaaaaaattgcagaacgaatataagttatgggctagagaatgaacctacagcaacttatacaatgttttctgcttttcaggaaggtagcaaaaaatcacaaacagattgcatattatctgatacatccccctctttcccctggtatagacacgtttccaatgatagtaggaaaacagataaattaattggtttctccaaaccaatcgtccgtaagaagctaagcttgagttcacagctaggatctttagagaagtttaagaggcaatatgggaaggttgaaaatcctctggatacagaagtagaggaaagtaatggagtcactaccaatctcagtcttcaagttgaacctgacattctgctgaaggacaagaaccgcttagagaactctgatgtttgtaaaatcactactatggagcatagtgattcagatagtagttgtcaaccagcaagccacatccttaactcagagaagtttccattctccaaggatgaagattgtttagaacaacagatgcctagtttgagagaaagtcctatgaccctgaaggagttatctctctttaatagaaaacctttggaccttgagaagtcatctgaatcactagcctctaaattatccagactgaagggttccgaaagagaaactcaaacaatggggatgatgagtcgttttaatgaacttccaaattcagattccagtaggaaagacagcaagttgtgcagtgtgttaacacaagatttttgtatgttatttaacaacaagcatgaaaaaacagagaatggtgtcatcccaacatcagattctgccacacaggataattcctttaataaaaatagtaaaacacattctaacagcaatacaacagagaactgtgtgatatcagaaactcctttggtattgccctataataattctaaagttaccggtaaagattcagatgttcttatcagagcctcagaacaacagataggaagtcttgactctcccagtggaatgttaatgaatccggtagaagatgccacaggtgaccaaaatggaatttgttttcagagtgaggaatctaaagcaagagcttgttctgaaactgaagagtcaaacacgtgttgttcagattggcagcggcatttcgatgtagccctgggaagaatggtttatgtcaacaaaatgactggactcagcacattcattgccccaactgaggacattcaggctgcttgtactaaagacctgacaactgtggctgtggatgttgtacttgagaatgggtctcagtacaggtgtcaaccttttagaagcgaccttgttcttcctttccttccgagagctcgagcagagaggactgtgatgagacaggataacagagatactgtggatgatactgttagtagcgaatcgcttcagtctttgttctcagaatgggacaatccagtatttgcccgttatccagaggttgctgttgatgtaagcagtggccaggctgagagcttagcagttaaaattcacaacatcttgtatccctatcgtttcaccaaaggaatgattcattcaatgcaggttctccagcaagtagataacaagtttattgcctgtttgatgagcactaagactgaagagaatggcgaggcaggtgggaacctgctcgtgctggtggatcagcacgctgcccatgagcgtatacgtctggagcagcttatcattgattcctacgagaagcaacaggcacaaggctctggtcggaaaaaattactgtcttctactctaattcctccgctagagataacagtgacagaggaacaaaggagactcttatggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggaatttatccgagaacaactggagctactccagaccaccggaggcatccaagggacattgccactgactgtccagaaggtgttggcatcccaagcctgccatggggccattaagtttaatgatggcctgagcttacaggaaagttgccgccttattgaagctctgtcctcatgccagctgccattccagtgtgctcacgggagaccttctatgctgccgttagctgacatagaccacttggaacaggaaaaacagattaaacccaacctcactaaacttcgcaaaatggcccaggcctggcgtctctttggaaaagcagagtgtgatacaaggcagagcctgcagcaatccatgcctccctgtgagccaccatgagaacagaatcactggtctaaaaggaacaaagggatgttcactgtatgcctctgagcagagagcagcagcagcaggtaccagcacggccctgac

SEQ ID NO: 2606 - DNA, 583 bp, Homo sapiens
gtgggcacgcacgagcctcaagatccaagttgctgccggctgcttagtgcattagcttagaaagcagcagaaattctgcagttaagagccctgatttgtcccgagtttggaaaaccggccccaccgcctgcaggggcccacccacgtggctctcactgatggagaagaaggggagacctttaatggcactggaatcttagggcaattatttccagtcagagaaggaaaccagtgcctggcattctcaccatctttctacctaccatgatcaagtgcttgtcagttgaagtacaagccaaattgcgttctggtttggccataagctccttgggccaatgtgttgaggaacttgccctcaacagtattgatgctgaagcaaaatgtgtggctgtcagggtgaatatggaaaccttccaagttcaagtgatagacaatggatttgggatggggagtgatgatgtagagaaagtgggaaatcgttatttcaccagtaaatgccactcggtacaggacttggagaatccaaggttttatggtttccgaggagaggccttggcaaatattgctgacatggccagtgctg

SEQ ID NO: 2607 - DNA, 3307 bp, Homo sapiens
gcagtagctaaagtcaccagcgtgcgcgggaagctgggccgcgtctgcttatgattggttgccgcggcagactcccacccaccgaaacgcagccctggaagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttga

SEQ ID NO: 2608 - DNA, 2917 bp, Homo sapiens
tcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaa

SEQ ID NO: 2609 - DNA, 3628 bp, Homo sapiens
aaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagaacctcagagtgacagagccaaaagaccagtgcctcattttgctgacatggaaaaggaaacttcgtgggggaaagagatctgcttgcagtcggccagagagacagaaccagggcagtggtgagctctcatgacctggtgtctgttgccttctggttaagtttttcatttgtaattctacaaacatcccttctgtaaacatttccctcaaaatggagcaggaagctctcaaaaatggaccagaaaggggtcaggaatataactttctctgcccagattccaggacttacagtgagaaagcgccttctgggaacttcacaatggctaaagtgtgctaatgggatgatgtgcccttgtacacccactgcctctgaactctgctctgcattgctgagcaaactacatttcccagaactccttgttggattccttccaaacaggtttaccactgggagagcctgttggttggggagggcaggaagagggaggaaagaggaagggactcacttcctgtttccagctgaagtctaaatcaatccactatcaacaggtagctatcatactaccctcattgtcacccctcagaggtcccactgcagctgcataatgtcccctcagtggcctgaacatgagatgaacaacactcttcttgggagtaccagccttgcttggttcatggccacttttcctgattatcttgcagctatattaggtcatgtgacaaagttctggccagtggcaagggaacacaagtgataggtacagatagaagtgtctgatactacatagattatgcttgcactcactcttaagagagagacatgaacttttaccaacggaagccagtattattttgaacctctgttagagtggcttgaatctgtatcctaacttgtatccctaatgtgtgacccatgaaaattagccaggcagc

SEQ ID NO: 2610 - DNA, 2537 bp, Homo sapiens
gtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtgg

SEQ ID NO: 2611 - DNA, 2918 bp, Homo sapiens
tcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaaccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaa

SEQ ID NO: 2612 - DNA, 1184 bp, Homo sapiens
gaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggaggatcacttcagcccaggagttcaagactagcctgtgccacatag

SEQ ID NO: 2613 - DNA, 2917 bp, Homo sapiens
tcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaa

SEQ ID NO: 2614 - DNA, 2918 bp, Homo sapiens
tcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagattacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaa

SEQ ID NO: 2615 - DNA, 2917 bp, Homo sapiens
tcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaa

SEQ ID NO: 2616 - DNA, 3018 bp, Homo sapiens
aagctgattgggtgtggtcgccgtggccggacgccgctcgggggacgtgggaggggaggcgggaaacagcttagtgggtgtggggtcgcgcattttcttcaaccaggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtgg

SEQ ID NO: 2617 - DNA, 4092 bp, Homo sapiens
ccgcagacgcctgggaactgcggccgcgggctcgcgctcctcgccaggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggctgcagcggccgcagcggccgcagcgcccccagcgcccccagctcccgccttcccgccccagctgccgccgcacatagctacagaaattgacagaagaaagaagagaccattggaaaatgatgggcctgttaaaaagaaagtaaagaaagtccaacaaaaggaaggaggaagtgatctgggaatgtctggcaactctgagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagagattgcagcccgagagctcaatatttattgccatttagatcacaactttatgacagcaagtatacctactcacagactgtttgttcatgtacgccgcctggtggcaaaaggatataaggtgggagttgtgaagcaaactgaaactgcagcattaaaggccattggagacaacagaagttcactcttttcccggaaattgactgccctttatacaaaatctacacttattggagaagatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtgggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacagagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcgcagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctc

SEQ ID NO: 2618 - DNA, 4337 bp, Homo sapiens
atgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggctgcagcgcccccagctcccgccttcccgccccagctgccgccgcacatagctacagaaattgacagaagaaagaagagaccattggaaaatgatgggcctgttaaaaagaaagtaaagaaagtccaacaaaaggaaggaggaagtgatctgggaatgtctggcaactctgagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagagattgcagcccgagagctcaatatttattgccatttagatcacaactttatgacagcaagtatacctactcacagactgtttgttcatgtacgccgcctggtggcaaaaggatataaggtgggagttgtgaagcaaactgaaactgcagcattaaaggccattggagacaacagaagttcactcttttcccggaaattgactgccctttatacaaaatctacacttattggagaagatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtgggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacagagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcgcagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgct

SEQ ID NO: 2619 - DNA, 3266 bp, Homo sapiens
gcgcagttctcccgcccgtttcagcggcgcagcttctgtagttgggctactggaggggtcgctcagaaacctcatacttctcgggtcagggaaggtttgggaggatgctgaggcctgagatctcatcaacctcgccttctgccccggcggtttccccgtcgtcgggagaaacccgctcacctcagggtccccgctacaatttcggactccaggagactccacagagccgcccttcggtccaggtggtctctgcatccacctgtcctggcacgtcaggagctgcgggcgaccggagcagcagcagcagcagccttccctgccccgcgccaaactcccggccagctcaaggttcatactttggaaacaaaagagcttatgcagaaaacacagttgcatcaaattttacttttggtgcaagctcatcttctgcacgagatactaattatcctcaaacacttaaaactccattgtctactggaaatcctcagagatcaggttataagagctggacaccacaagtgggatattcagcttcatcctcatctgcgatttctgcacactccccatcagttattgtagctgttgtagaagggagaggacttgccagaggtgaaataggaatggcaagtattgatttaaaaaacccccaaattatactatcccagtttgcagacaacacaacatatgcaaaggtgatcactaaacttaaaattttatcacctttggaaataataatgtcaaatactgcttgtgctgtggggaattccaccaagttgttcactctgatcacagaaaatttcaagaatgttaatttcactactatccaaaggaaatacttcaatgaaacaaaaggattagagtacattgaacagttatgcatagcagaattcagcactgtcctaatggaggttcagtccaagtattactgccttgcagctgttgcagctttgttaaaatatgttgaatttattcaaaattcagtttatgcaccaaaatcactgaagatttgtttccagggtagtgaacagacagccatgatagattcatcatcagcccaaaaccttgaattgttaattaataatcaagactataggaataatcacactctctttggtgttctaaattatactaagactcctggagggagtagacgacttcgttctaatatattagagcctctagttgatattgaaaccattaacatgagattagattgtgttcaagaactacttcaagatgaggaactattttttggacttcaatcagttatatcaagatttcttgatacagagcagcttctttctgttttagtccaaattccaaagcaagacacggtcaatgctgctgaatcaaagataacaaatttaatatacttaaaacataccttggaacttgtggatcctttaaagattgctatgaagaactgtaacacacctttattaagagcttactatggttccttggaagacaagaggtttggaatcatacttgaaaagattaaaacagtaattaatgatgatgcaagatacatgaaaggatgcctaaacatgaggactcagaagtgctatgcagtgaggtctaacataaatgaatttcttgacatagcaagaagaacatacacagagattgtagatgacatagcaggaatgatatcacaacttggagaaaaatatagtctacctttaaggacaagttttagctctgctcgaggatttttcatccagatgactacagattgtatagccctacctagtgatcaacttccttcagaatttattaagatttctaaagtgaaaaattcttacagctttacatcagcagatttaattaaaatgaatgaaagatgccaagaatctttgagagaaatctatcacatgacttatatgatagtgtgcaaactgcttagtgagatttatgaacatattcattgcttatataaactatctgacactgtgtcaatgctggatatgctactgtcatttgctcatgcctgcactctttctgactatgttcgaccagaatttactgatactttagcaatcaaacagggatggcatcctattcttgaaaaaatatctgcggaaaaacctattgccaacaatacctatgttacagaagggagtaattttttgatcataactggaccaaacatgagtggaaaatccacatatttaaaacagattgctctttgtcagattatggcccagattggatcatatgttccagcagaatattcttcctttagaattgctaaacagatttttacaagaattagtactgatgatgatatcgaaacaaattcatcaacatttatgaaagaaatgaaagagatagcatatattctacataatgctaatgacaaatcgctcatattaattgatgaacttggcagaggtactaatacggaagaaggtattggcatttgttatgctgtttgtgaatatctactgagcttaaaggcatttacactgtttgctacacatttcctggaactatgccatattgatgccctgtatcctaatgtagaaaacatgcattttgaagttcaacatgtaaagaatacctcaagaaataaagaagcaattttgtatacctacaaactttctaagggactcacagaagagaaaaattatggattaaaagctgcagaggtgtcatcacttccaccatcaattgtcttggatgccaaggaaatcacaactcaaattacgagacaaattttgcaaaaccaaaggagtacccctgagatggaaagacagagagctgtgtaccatctagccactaggcttgttcaaactgctcgaaactctcaattggatccagacagtttacgaatatatttaagtaacctcaagaagaagtacaaagaagattttcccaggactgaacaagttccagaaaagactgaagaataatcacaattctaatgtaataatatatcttaattcaaggaacctagaatttatttttctccttagagataaggaaaataacatttgccaaatttcatattttaattgaaaattacattatattaacatcacaattgtcatctatatattctatatgaaaaatatttattataacttaacaaatgagaactacttaaaggaatggtttttatgttaggagaaaatacaatacaccacttttttctcacaaaaattcacattattaagacctaagttcatttatacttacaagttatagtttaaaatattattgtaaataccctagtttaataaacacctttctttttaggtctg

SEQ ID NO: 2620 - DNA, 1046 bp, Homo sapiens
cgctccttttgcaggctcgtggcggtcggtcagcggggcgttctcccacctgtagcgactcaggttactgaaaaggcgggaaaacgctgcgatggcggcagctgggggaggaggaagataagcgcgtgaggctggggtcctggcgcgtggttggcagaggcagagacataagacgtgcacgactcgccccacagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcag

SEQ ID NO: 2621 - DNA, 867 bp, Homo sapiens
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcag

SEQ ID NO: 2622 - DNA, 694 bp, Homo sapiens
gcgccggcgcgctccttttgcaggctcgtggcggtcggtcagcggggcgttctcccacctgtagcgactcagggccctcagaccccttccttccaaaggagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaaga

SEQ ID NO: 2623 - DNA, 891 bp, Homo sapiens
gcgcgctccttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcag

SEQ ID NO: 2624 - DNA, 918 bp, Homo sapiens
gcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacacccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcag

SEQ ID NO: 2625 - DNA, 323 bp, Homo sapiens
aaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacagtgttctacagatttttaagagtgagtctcacccctcagtgtacaaagtggccagtggactgaaggaggggctcagcctctttggaatcctcaacagatgccactgtaagtggggagagaagctgctcag

SEQ ID NO: 2626 - DNA, 944 bp, Homo sapiens
cttttgcaggctcgtggcggtcggtcagcggggcgttctcccacctgtagcgactcagagcctccaagctcatggcctccttaggagcgaacccaaggaggacaccgcagggaccgagacctggggcggcctcctccggcttccccagcccggccccagtgccgggccccagggaggccgaggaggaggaagtcgaggaggaggaggagctggccgagatccatctgtgtgtgctgtggaattcaggatacttgggcattgcctactatgatactagtgactccactatccacttcatgccagatgccccagaccacgagagcctcaagcttctccagagagttctggatgagatcaatccccagtctgttgttacgagtgccaaacaggatgagaatatgactcgatttctgggaaagcttgcctcccaggagcacagagagcctaaaagacctgaaatcatatttttgccaagtgtggattttggtctggagataagcaaacaacgcctcctttctggaaactactccttcatcccagacgccatgactgccactgagaaaatcctcttcctctcttccattattccctttgactgcctcctcacagttcgagcacttggagggctgctgaagttcctgggtcgaagaagaatcggggttgaactggaagactataatgtcagcgtccccatcctgggctttaagaaatttatgttgactcatctggtgaacatagatcaagacacttacaggctggagtgcaatggtgcgatctcggctcaatgcaacctctgcctcctgggttcaagcgattctcctgcctcagcctcctgagtaactgggattacaggcacctgccaccacgcccagctaatttttgtatttttagtagagacggggtttcaccatgttgcccaggctggtcttgaactcctgacctca

SEQ ID NO: 2627 - DNA, 4328 bp, Homo sapiens
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 2628 - DNA, 908 bp, Homo sapiens
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaaggaaaaagagg

SEQ ID NO: 2629 - DNA, 4055 bp, Homo sapiens
gagtccggtggtgtggggtgcgaaaggaggttcctcggccggcgcggagatagtgagttggggctccagtagtcgatcgaggtagacacttagaggtagttaagagccgcggtcgccgagacgccttggggacggtgggccttcggcctagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttatttttt

SEQ ID NO: 2630 - DNA, 3829 bp, Homo sapiens
gcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttatttttt

SEQ ID NO: 2631 - DNA, 4308 bp, Homo sapiens
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaaattgtgtgcttgttactggaccaaatatggggggcaagtctacgcatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccatattagtagaagattattctcaaaatgttgctgtctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttatttttt

SEQ ID NO: 2632 - DNA, 3353 bp, Homo sapiens
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgcctgcccccggggcctctccttccccaggcggggatgcggcctggagcgaggctgggcctggaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttga

SEQ ID NO: 2633 - DNA, 1744 bp, Homo sapiens
cgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 2634 - DNA, 1776 bp, Homo sapiens
tcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 2635 - DNA, 1839 bp, Homo sapiens
ggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 2636 - DNA, 1808 bp, Homo sapiens
tcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtt

SEQ ID NO: 2637 - DNA, 1823 bp, Homo sapiens
ctccgtgttctgctgtcttcatcagcgtgggccgcgggtatctattgtgtacagtttacctggcactgactttggacacacaccaatcaacaagagaatcagtccttgcactcaagtcgttttttacagtcaaattcaggaagtacacactgatggaaagaatcaaagtaatgtaaaattacattaggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 2638 - DNA, 1809 bp, Homo sapiens
ggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 2639 - DNA, 1888 bp, Homo sapiens
cagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 2640 - DNA, 904 bp, Homo sapiens
ccgggcgcgctagagctcgcgggaggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggca

SEQ ID NO: 2641 - DNA, 1706 bp, Homo sapiens
ctccgtgttctgctgtcttcatcagcgtgggccgcgggccatcatgaggaagccacgagcagccgtgggaagtggtcacaggaagcaggcagccagccaggaagggaggcagaagcatgctaagaacaacagtcaggccaagccttctgcctgtgatgggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 2642 - DNA, 1929 bp, Homo sapiens
cagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatgcctgtgcagggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtt

SEQ ID NO: 2643 - DNA, 1692 bp, Homo sapiens
cgcggcgggaacgcggggcctccgtgttctgctgtcttcatcagcgtgggccgcgggccatcatgaggaagccacgagcagccgtgggaagtggtcacaggaagcaggcagccagccaggaagggaggcagaagcatgctaagaacaacagtcaggccaagccttctgcctgtgatggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggcagaagatgagatggacctggacaggcgggcatatgctgtgtgggtctcagaggtcatgctgcagcagacccaggttgccactgtgatcaactactataccggatggatgcagaagtggcctacactgcaggacctggccagtgcttccctggaggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtta

SEQ ID NO: 2644 - DNA, 1245 bp, Homo sapiens
atgacaccgctcgtctcccgcctgagtcgtctgtgggaggtgaatcaactctgggctggcctgggctactattctcgtggccggcggctgcaggagggagctcggaaggtggtagaggagctagggggccacatgccacgtacagcagagaccctgcagcagctcctgcctggcgtggggcgctacacagctggggccattgcctctatcgcctttggccaggcaaccggtgtggtggatggcaacgtagcacgggtgctgtgccgtgtccgagccattggtgctgatcccagcagcacccttgtttcccagcagctctggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtggagcaggaacagctcttagcctcagggagcctgtcgggcagtcctgacgtggaggagtgtgctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtt

SEQ ID NO: 2645 - DNA, 1029 bp, Homo sapiens
ggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggccatcatgaggaagccacgagcagccgtgggaagtggtcacaggaagcaggcagccagccaggaagggaggcagaagcatgctaagaacaacagtcaggccaagccttctgcctgtgatggaggtgaatcaactctgggctggcctgggctactattctcgtggccggcggctgcaggagggagctcggaaggtctgctggcaggactgtgggagttcccgtccgtgacctgggagccctcagagcagcttcagcgcaaggccctgctgcaggaactacagcgttgggctgggcccctcccagccacgcacctccggcaccttggggaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggttttccgtgtgtatcagggccaacagccagggacctgtatgggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagttattttatgttgtatttttttgagatgggggtctcgctatgttgctcagactggtttcgaactcaggtgattctggcctca

SEQ ID NO: 2646 - DNA, 897 bp, Homo sapiens
ggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaagctctatttcctcttttggaaattgtgtactcctgtccttcatcgtcaaagtttgatgcagaaatgccacaccttcatttcaagctaccaagtgcacaagaaaaaagaatgcaagatttaaaaaatgattgttttgaccccttacacaaatgtcttactcctggctttaattaagctgcttgagggctgatagctctgccttaccctggtaatcagcaaaatggtcctgtggctggggaggccctggcagcaggaagccttcaaggagccatgggtctgtgctgactctggccttacaaccttccagcctcctttgctggcattgatggggttccatttttgaatgaactagtttaatgtggatccaaatttattgtgcatattctttcgttttggttttcaaaagatggcttattcacatggaaatgtacaccagtttagccctgggccctccctttaccttcatatgtgtaaaagcttacacaggtttcagaaaataaatggtttcattttctctaaaataactagtacaaaataaaacagatgtcagttgttga

SEQ ID NO: 2647 - DNA, 3155 bp, Homo sapiens
gtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggtgagcacccgagctcgtggggcagctggccctgctgtgctccagccaggtcaggctttggcacctgggcctgcagagtcagagccagtcatggagtatgtgctcagtagcaggcttggtcctgcttcttggggcctgagtaactgagtgttagagccgtcctgaggaaggacctgaggcgccagtgaggagacagtggaagctaggaagttggacatctggagacttgtatcttttctggcctgacctctccccttcttggggctcaggtgctctgcctgcagtagggatcacacctggcatcaggtgtctgaaaagagctttgaggtccttggagtggaatgtgctgtgtaagtaccagagactccaggtgttcagggacagtgagccctccccattgtcaatggtagtccaatcagggcagcctatgggctaggcccatgctgttctcaatgctcacacccgccttttcctacaaccacaggggaaagcgagagctgatcaagttctttgttcctggggaattcacttctcttcctccctcatggaagatgcaagtaaaaggaaatgcaagtaaccacctgggttagaaaacctcaaataaaataaaataaaataaattaaatgggttgaccttccaggctcaagctgagctgaaccaagggatgggcagtgggtggtgtcagtgggttggttactgggccaggcagcctgcatgtaggggctatttgaaaagcccaggtattttatgtgtattggtgacttgcttccaagtgtccagcttgtcattccaagtggatcttgtacacgagagctaagccaaaactgttctttggctgatacgtcttatgtcatcctttcctgctgttgtgtggcctcacaccttgtggagcctcatgctcctgggccagcttctcctctgttattgcactgctgaatcccacagggagctcacgctccagtctctccacggggcttccacggcaggacggtgacatcacaagccttctcttcagagttgggtgggattgcagagtgtctgctggctcccaggtccagctgggaaaggcgggagggaaatgaagtgtgtgagtgaacagccacccgaagggagctacttctgagcatcttgagcctcgggggccaacaagcaagcccttaggaagaacaggctggaccctgagtctgagactcggttactccccaagtctccagaaggcagtaacacactcccttggttgccttttagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatac

SEQ ID NO: 2648 - DNA, 330 bp, Homo sapiens
ttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaagggaacaaagatgaagttaaccctcccacctgtctttccttatgaacacttgccttttccaactgttttctgccatggctaatcagaaaaagtttcttaaggaaatggtggc

SEQ ID NO: 2649 - DNA, 1973 bp, Homo sapiens
ttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatccttctt

SEQ ID NO: 2650 - DNA, 1546 bp, Homo sapiens
gagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaagtccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatcttt

SEQ ID NO: 2651 - DNA, 1090 bp, Homo sapiens
tgactccccaccctccgcttcctctgccgccggcattttctttcttattattgaatgttaagtgtaaaaataacttctatattttctatttttttttttctcttattccaggaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggtgagcacccgagctcgtggggcagctggccctgctgtgctccagccaggtcaggctttggcacctgggcctgcagagtcagagccagtcatggagtatgtgctcagtagcaggcttggtcctgcttcttggggcctgagtaactgagtgttagagccgtcctgaggaaggacctgaggcgccagtgaggagacagtggaagctaggaagttggacatctggagacttgtatcttttctggcctgacctctccccttcttggggctcaggtgctctgcctgcagtagggatcacacctggcatcaggtgtctgaaaagagctttgaggtccttggagtggaatgtgctgtgtaagtaccagagactccaggtgttcagggacagtgagccctccccattgtcaatggtagtccaatcagggcagcctatgggctaggcccatgctgttctcaatgctcacacccgccttttcctacaaccacaggggaaagcgagagctgatcaagttctttgttcctggggaattcacttctcttcctccctcatggaagatgcaagtaaaaggaaatgcaagtaaccacctgggttagaaaacctcaaataaaataaaataaaataaattaaatgggttgaccttccaggctcaagctgagctgaaccaagggatgggcagtgggtggtgtcagtgggttggttactgggccaggcagcctgcatgta

SEQ ID NO: 2652 - DNA, 615 bp, Homo sapiens
agtgaggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaatgcaagtaaccacctgggttagaaaacctcaaataaaataaaataaaataaattaaat

SEQ ID NO: 2653 - DNA, 2097 bp, Homo sapiens
gcagtgaggaggtggttcttgcccgtgttgtgtgtgtgtgtgagtgagagagcgagtgagtgagtgagtgagtgtgtgtgtgggggggactcggcttgttgttgtcggtgacttccccctccccttcaccccttcccctccccgccgccgctgcagtggccgctccctgggccgtaggaaatgagcgataacgatgacatcgaggtggagagcgacgaagagcaaccgaggtttcaatctgcggctgacaaacgggctcatcataatgcactggaacgaaaacgtagggaccacatcaaagacagctttcacagtttgcgggactcagtcccatcactccaaggagagaaggcatcccgggcccaaatcctagacaaagccacagaatatatccagtatatgcgaaggaaaaaccacacacaccagcaagatattgacgacctcaagcggcagaatgctcttctggagcagcaaggggaaagcgagagctgatcaagttctttgttcctggggaattcacttctcttcctccctcatggaagatgcaagtaaaaggaaattccgtgcactggagaaggcgaggtcaagtgcccaactgcagaccaactacccctcctcagacaacagcctctacaccaacgccaagggcagcaccatctctgccttcgatgggggctcggactccagctcggagtctgagcctgaagagccccaaagcaggaagaagctccggatggaggccagctaagccactcggggcaggccagcaataaaaactgtctgtctccatcgtctcatcctcctttcagttcgttggtagagccctcagaaccatttaagagactctttatttttctctttctcccttttttttttaaatttttatttttacgtagaagctcttggacaacagctctcgttctccttccccatttccactgtatattttttaatgtattcccttcagggattccctgtccccaacaggaatttttaaaccaaaacaccccaacttggcagctttttctgtggaggacagacggccggccggacctctgagcacatagtgtcctgcccaccctaccagctcctccagccctgccgggcacatgcccgggggacgcctgccctgcccaggtggcctcctggcccgccctcacctctgatagactttgtgaatctgaactgctctactttgagaagatgaccggtttggagtaatcagaatgaaccctcctcctttttaagggttttttttttttcctttttctaaaaagctatgtatcgctcctattgaaagaccagatccttagagaagtttgtggtataaaaaggaagtggggacagattcgcagcacagagtcgctggcatgtttcactcctgcttctctcagccagctgtttaagcctgcggcgccagcctcacggagggccgtgtgacactctcgtggtatgtatgggagatggcagcagtgaagcagcagccaccagggagtggccatttggggttgggacagggagggtgttttgggtggcatagaggttttgtattgagggccagtgatgatgttttgatatttatttcctgctacttaaatttgaatctgagtgaattgtacctatttctgatgatgtcggtcttgcaaagcgacagattcataaagtaatgatgaaatctttctttcttcccgtgtgtatttctaagaaatagagccaactgattttgtatgtaaataccaagagcaatttacctggtactaaacccgcaccccagtgcggacccttcccagccctcatcccacttcctttcctactgtcctggaacctgtctccattgtgtgatccagccctggttctggctgtggtcagcagatgccagtgaagggttttgtgtgtttaggcctcatttctttgtctttttcctactccgttcctggcatttgctgatttctagtgtatactctgtagtctcagttcgtgtttgattccattccatggaaataaaaagtatgttgtacatactgccgaagaattgtcttgcaagttaaggcttccccctttactataagactataaataaaaacttattttatcctt

SEQ ID NO: 2654 - DNA, 14735 bp, Homo sapiens
cggcggcagtggcggcaccgcctcctcctcacattcccggggtggcggggttagatgagcggccccagtagcggcgccgggggcgctgttcatgccggttcccgacggctccgtggctgctgcggggctggggctggggctacccgccgcggactcccggggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaaggcctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaactaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacagctaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaggagttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacgaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 2655 - DNA, 9243 bp, Homo sapiens
ggcggcggcagtggcggcaccgcctcctcctcacattcccggggtggcggggttagatgagcggccccagtagcggcgccgggggcgctgttcatgccggttcccgacggctccgtggctgctgcggggctggggctggggctacccgccgcggactcccggggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaaggcctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaactaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacagctaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaggagttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacgaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaagttttgactgttttacccactgcaggtgaccaactgagtgccatattgaattccattcagtcacgacccaatctcccagctccttccatctttgatcaagctgcaaaacctccctcttccctagtacacagcccatttgtgttcggacagcccctttccttccagcagcctcagcttcagagtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaagaaaaatcgagttttcttttcaaaggagatggatccaagcctttagagccagccaagcaagccatgtctccttctgtggccga

SEQ ID NO: 2656 - DNA, 15025 bp, Homo sapiens
cggcggcagtggcggcaccgcctcctcctcacattcccggggtggcggggttagatgagcggccccagtagcggcgagggcggcgcgggggggaggaggagaagaaggaggaggagaaggaggtcgctgtctttgtagtctccctgctgcgggagccagaggccgccgccggagccgtcgtcgttggaaaagggctgtgtgtgcgcgcgcgtgtctgcccgcccggcccgcggggacgaggcggcggcggcggcggcggcggcgaggatgatgatgtgcgcagcgactgcctcccccgccgccgcctcctcggggctcggcggggacggattctacccagccgccaccttctcttcctccccggcgccgggggcgctgttcatgccggttcccgacggctccgtggctgctgcggggctggggctggggctacccgccgcggactcccggggtcactaccagctgctgctgtcaggccgggccctggccgaccgctaccggaggatttataccgctgcgctcaatgacagggaccaggggggcggcagcgctggacacccagcctccaggaataagaaaattttaaataagaagaaattgaaaagaaaacagaagagcaaatcaaaagtgaagacaagaagcaagtctgaaaacttagagaatacagtaatcataccagatatcaaactacatagcaatccttctgctttcaatatttactgtaatgtacgccattgcgttctggaatggcagaaaaaggaaatatcattggcagccgcatctaagaactctgtgcagagtggagaatcagatagtgatgaagaagaggaatccaaagagccccctatcaagcttccaaagattattgaggttggcctttgtgaagtttttgaattgatcaaagagacacgattttctcatccatccctgtgtctcaggagtctccaagccctgctcaacgtgctgcagggccagcagccagaaggcctccagtctgagccacctgaggtcctagagtctctcttccagcttcttttggaaatcaccgttcgaagtactgggatgaatgacagcacaggacagtccttaacagcactttcctgtgcttgcctctttagtctggtggcttcttggggagaaacaggaaggacacttcaggccatctctgctatcctcaccaacaatggaagccatgcttgccaaactattcaggtgccaacaattctaaattcgctacagagaagtgtacaagcagttttggtgggaaaaattcaaattcaggactggtttagtaatggcattaagaaagcagctttaatgcacaagtggccattaaaagaaatatctgttgatgaagatgaccaatgtctacttcagaatgatggattttttctttatctattatgcaaggatggattatataaaataggctctggatacagtggaacagttaggggccatatatacaattctacatcccgtattagaaacagaaaagaaaaaaagtcttggttagggtatgctcagggttatttattatatagagatgtgaataaccacagcatgacagccataaggataagccctgaaacactggagcaagatggtactgtgatgttaccagattgccacactgaaggtcaaaatattttattcactgatggagaatatattaatcagatagctgcttcaagagatgatggctttgttgtcagaatatttgccacaagcactgaacctgttctacagcaagaattgcaacttaaactggctagaaaatgcttacatgcctgtggtatctcactattcgatctggaaaaggacttgcatattataagtacaggatttgatgaggagtcagcaattcttggtgcaggacgagagtttgcgctaatgaaaacagcaaatggaaagatatattacactggcaaataccagagtcttggaatcaaacaaggtggtccttcagcaggaaaatgggttgagctaccaattacaaaatctccaaagatagtacacttctcagttggacacgatggctctcacgcccttttagttgcagaagatgggagcatattctttacaggatctgctagtaaaggagaagatggagaatcaactaagagcagacggcaatccaaaccttataaacctaaaaagataattaagatggaaggaaagattgtggtatatacagcctgcaataatggaagtagttctgttatttctaaagatggagaactctacatgtttggaaaagatgccatttactctgatagttcaagtttggtaactgatttgaagggccattttgtaactcaggtagctatgggcaaagctcacacttgtgttttaatgaagaatggagaggtgtggacatttggtgtaaataataaaggacagtgtggacgagatactggtgccatgaaccaaggtgggaaagggtttggagttgaaaatatggcaacagcaatggatgaagacctggaagaagaactagatgaaaaagatgagaagtctatgatgtgccctccaggcatgcacaaatggaagctggagcagtgcatggtttgcactgtctgtggagactgtacaggttatggagccagctgtgtcagtagtggacggccagacagagtccccggagggatctgtggttgtggttccggagaatctggttgtgctgtgtgtggatgttgcaaggcctgtgcaagagagttagatggtcaagaggcaagacaaagaggaattcttgatgcagtgaaagaaatgatacctttagatcttcttttagctgtcccagtgcccggggttaacattgaagaacaccttcagttacgacaagaagaaaaacggcaacgtgtaatcagaaggcacagattagaggaaggaagaggcccccttgtatttgctggtcctatttttatgaaccatcgagaacaggctctagccagactcagatcccatccagcacagctaaagcataaacgggacaagcacaaagatggaagtggagaaagaggcgaaaaggatgcaagcaaaatcacaacataccctccaggctctgtgcgatttgactgtgagctccgggcagtccaagtcagctgtggatttcaccattcagtggttttaatggaaaatggagatgtctatacatttggttatgggcagcatgggcagctaggacatggagatgtcaactccaggggatgtcccactcttgttcaagcattgccaggccctagcacacaagtcactgcaggcagcaaccatacggcagtacttttaatggatggacaggtcttcacatttggaagtttttctaaaggacaactgggcagaccaattttggatgtgccatattggaatgcaaagccagctcccatgcctaacattggatcaaaatatggaagaaaagctacttggataggtgcaagtggggaccaaacttttttacgaattgatgaagcacttattaattctcatgtacttgctacatcagaaatttttgccagtaaacacataataggcttggtacctgcttctatatcagaacctcctccatttaaatgccttctgataaataaagtggatgggagttgtaaaacttttaatgactcagaacaagaggatctgcaaggatttggtgtgtgtcttgatcctgtatatgatgtaatttggaggtttcgaccaaatactagagagctgtggtgttacaatgcggtggttgctgatgccaggcttccctctgcagcagacatgcagtccagatgtagtatcctaagtcctgaacttgccttaccaacaggatcaagggccctcactacccgatctcatgcagctttgcacattttaggttgtcttgataccttggcagctatgcaggacttaaaaatgggtgttgcaagtacagaggaagagactcaagcagtaatgaaggtttattctaaagaagattatagtgtggtaaacaggtttgaaagtcatggaggaggctggggttattctgcccattcagtagaagctatacgtttcagtgccgacactgatattttacttggtggtcttggtctgtttggaggtagaggagaatatactgctaaaattaagctgtttgaattgggtcctgatggaggagatcatgaaactgatggtgaccttcttgcagagactgatgtattggcttatgactgtgctgctagagaaaaatatgcaatgatgtttgatgagcctgttctcctgcaagctgggtggtggtatgtggcatgggcccgagtgtcaggacccagcagtgactgtggatctcatggacaggcatctattaccacagatgatggggttgttttccagttcaagagttcaaagaaatcaaataatggtacagatgttaatgcgggtcagatacctcagttattatacagacttccaaccagtgatggcagtgcttcaaaaggcaaacagcaaaccagtgaacctgtacacattttaaagaggtcttttgcaagaactgtctcagtggaatgttttgagtcattgttgagtattcttcactggagctggaccaccttagtcttaggagttgaagaacttagaggattaaaaggattccagttcacagctacactcctagatttagagagactgcgctttgtgggtacctgttgtctgaggttattgcgtgtctatacctgtgaaatttacccagtgtcagctacaggaaaagcagttgtagaagaaactagcaaattagcagagtgtattggaaaaaccagaactttgttaagaaaaattttatcagaaggagttgatcactgcatggtgaaattggataatgatcctcaaggatatctcagtcaacccttgagtcttctagaagctgtccttcaggaatgtcataatactttcactgcctgctttcattctttctacccaactcctgccttacagtgggcttgcctttgtgatctgctgaattgtttggatcaggatatccaagaagcaaacttcaagacatcaagtagccgactccttgcagctgttatgtcagctctgtgtcacacgtctgttaagctgacttccatcttcccgattgcgtatgatggagaagtattactacgatcaattgttaaacaagttagtacagagaacgactcaacactagttcatcgttttccccttttggtggcacatatggaaaaactcagccagagtgaagagaatatctcagggatgacaagcttccgtgaagttctggagaaaatgctggtcattgttgtgctaccagtcaggaacagcctgaggagagaaaatgaactcttctcctcccacctcgtctctaacacctgtggattactggccagcattgtcagtgaactgacagcgtcagccctgggatctgaggttgatggacttaattctcttcactctgtaaaagctagtgctaaccgatttacaaaaacaagtcagggcagaagttggaacactgggaacgggtcccctgatgcaatctgtttttcagtagacaaacctggaatagttgtggttggtttctctgtctatggaggaggtggaattcatgaatatgaattagaggtgttggttgatgatagtgaacatgcaggagattcaactcattcccacagatggacatctctggaattagtgaaaggaacgtacacaacggatgactcacccagtgatatagctgagatcagacttgacaaagtggttcctttaaaggaaaatgttaaatatgctgtgcgcttgaggaactatggaagccgtacagccaatggagatggaggaatgaccacagttcagtgccctgatggtgtgacattcacattcagcacgtgcagcttgagcagtaacggcacaaaccaaaccagaggacagatcccacagatactctactataggagtgaatttgatggagatttacaatcccaacttctgagtaaagccaatgaagaagataaaaactgtagcagagcattgtctgttgtaagcactgtcgttcgagcctctaaggacctcctgcacagagctcttgctgtggatgctgatgacattccagaactgctgagttcttccagtctgttttccatgctgctcccccttattatagcctacataggaccagtagctgctgctattcccaaggtggctgtagaagtctttggccttgtccaacaattgcttccgtcagttgccattttgaatcagaagtatgcaccgcctgccttcaaccctaatcagtcgacagatagcaccacaggaaaccagcctgaacagggcctctctgcttgtacaacctccagtcactatgctgtcatagagagtgagcacccgtataaacctgcctgtgtgatgcattacaaggtgacattcccagaatgtgtgaggtggatgacaatcgaatttgaccctcagtgtggtactgcacagtcagaagatgtccttcgtttgttgattcctgtcagaactgttcagaattcaggatatggaccaaaattgacatctgttcatgaaaatcttaattcatggatagaattaaagaaattttcaggatcctctgggtggcctactatggttttggtgttgccaggaaatgaggcccttttttcattggagactgcatcagattatgtgaaagatgacaaagcttctttctatggttttaagtgttttgcaattggatatgaatttagccctggacctgatgagggagtcatccaattggaaaaagaattagccaatcttggtggggtttgtgcagcagctctgatgaagaaggacctagcacttcctattggtaatgaattagaagaagaccttgaaattcttgaggaggctgcattgcaggtgtgcaaaacccattctggaattcttggaaagggtctagctctttctcattcaccaactatattagaagcacttgagggaaatttaccactccaaatccaaagcaatgaacagtcttttctggatgattttattgcctgtgtcccaggatcaagtggtggaaggcttgcaaggtggcttcagccagattcatatgcggatcctcagaaaacatctttgatcctgaataaggatgatattcgttgtggttggcctaccaccataactgttcaaacaaaagaccagtatggggatgtggtacatgttcccaatatgaaggtggaagtgaaagctgtccctgtttctcagaaaaaaatgtctttacaacaagatcaagcaaagaaacctcaaaggattcctggcagtcctgcagtaacagctgcatcttctaatactgacatgacttatggagggctggcatcaccaaagctagatgtttcatatgaaccaatgatagtgaaggaagctcgatatattgccataacaatgatgaaggtttatgaaaattattcatttgaagaactacgttttgcatcaccaactcctaagagacccagtgagaatatgctgatccgtgtcaataatgatgggacttattgtgcaaattggactccaggggctattggactctacactcttcatgttaccattgatggcattgaaatcgatgctggtctggaagtaaaagtaaaagacccaccaaaagggatgataccaccaggaactcagttggtcaaaccaaagtctgaacctcagcctaataaggttcgaaaatttgtggccaaggacagtgcggggcttcgcatccgtagccacccttcccttcagagtgagcagataggcatagtgaaagtcaatggaactatcacttttattgatgagatccataatgatgatggtgtgtggctgaggctgaatgatgagacaataaagaagtatgtccctaacatgaatggttacactgaagcctggtgcctctcttttaatcaacatcttggcaagagtcttctggtccctgttgacgaatctaaaactaatactgatgactttttcaaagacataaactcctgctgcccacaggaagcaacaatgcaagaacaagatatgccattcttgcgaggagggccaggcatgtacaaggtagtgaagacgggaccttcaggtcacaacatcagaagctgccctaaccttagaggtatcccaattggaatgttagttctgggaaacaaagtcaaagcagtgggagaggtaaccaattctgaagggacatgggtgcaactggatcagaacagcatggtagagttctgtgagagtgatgaaggagaggcatggtccttagctagagacagaggcggaaaccagtacctccgacatgaagatgaacaagctcttctggatcagaattctcaaactcctcctccaagccctttctcagtgcaagcttttaataaaggggcaagttgcagtgcccaaggatttgattatggactcggaaatagcaaaggtgatcgaggaaacatctcaacatcttctaaaccagcctctacatcaggaaaatcagagctgtcctctaaacacagcagatcgcttaaacctgatggacgtatgagccggactactgctgatcagaagaagccaaggggcacagaaagtttatctgctagtgaatccctcatcttaaaatctgatgctgcaaagttgaggtcagattcccacagtaggtcattatcccccaaccataacaccttgcagacattgaaatctgatgggaggatgccttctagctccagagctgaatccccaggaccaggttctcggttgtcatctcctaagccaaagactctcccagccaataggtctagcccatcgggtgctagttctccacgctcctcctcaccacatgataaaaatctacctcaaaaaagtactgctcctgttaagacaaagcttgatcctcctcgggaacgttctaaatcagactcttacacacttgatccagataccctccgcaagaagaaaatgcccctcacagaacctttgagaggacggtcaacgtcaccaaaaccaaaatcagtaccaaaggattctacagattcccctggatctgaaaatagagctccctctccccatgtggtacaggaaaacctccacagtgaggtggtcgaagtctgcacctcaagtactttaaaaacaaatagtctaacagacagcacctgcgatgacagcagtgaatttaagagtgtggatgaaggttcaaataaagttcattttagcattggaaaagcaccactgaaagatgaacaggaaatgagagcatctcccaaaataagtcgaaaatgtgctaatagacacaccaggcccaaaaaagaaaaatcgagttttcttttcaaaggagatggatccaagcctttagagccagccaagcaagccatgtctccttctgtggccgaatgtgccagagctgtgtttgcttccttcctctggcatgaaggcatagtacatgatgcaatggcttgttcttctttcctaaagtttcatcctgaactttccaaagaacatgctcctataaggagtagtttaaatagccaacaacctacagaggaaaaagaaaccaagttaaaaaatagacattcattagaaatatcatctgcactgaatatgtttaatattgcaccccatggaccagatatatctaagatgggtagcatcaacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttcttaaaaagaaagagtgtgagaaagagaataagaagtccaaaaaggaaaaaaagaaaaaagaaaaggcagaagttaggcccaggggtaatttgtttggagagatggcccagctggcagtaggaggaccagagaaagataccatctgtgaactgtgtggggagtcacatccatacccggtgacctatcacatgagacaagctcacccaggttgtggccgatatgctggtggacaaggttacaatagcattgggcatttttgtggaggatgggctggtaactgtggtgatggtggcataggaggaagcacttggtatctggtatgtgatcgctgtagagaaaaatacctccgcgaaaaacaggctgctgcaagggagaaggtcaaacaatctaggagaaaaccaatgcaagtcaagacccctcgtgccttgcccaccatggaagctcaccaggtgattaaagccaatgcactcttcctgctgtccctgagcagtgcagcagaaccgagcattctgtgttaccatcctgcaaagccattccaatctcagttgcccagtgtaaaagaaggcatttctgaggatcttcctgtgaaaatgccttgtctctacctgcagacattagctaggcatcatcatgaaaattttgtgggctatcaagatgacaatctattccaggatgaaatgagatatctacgttcaacatctgtacctgccccgtatatatcagtaactcctgatgcaagtcctaatgtatttgaagagccagagagcaatatgaagtctatgccaccaagtttagaaaccagtcccataactgatactgatcttgcaaagagaactgtcttccaaagatcatactcagttgttgcttccgaatatgataaacaacactccattttacctgcacgagttaaagctattcctagaagaagagttaacagtggagacactgaagttggttcttcccttttgagacatccgtctcctgagctttctcggctaatctcagcccacagctctctttctaaaggagaacgaaatttccagtggccagttttagcttttgttatacaacatcatgatctagaaggtcttgaaatagcaatgaaacaggccctaaggaaatctgcttgtcgagtttttgctatggaggctttcaactggcttctgtgtaatgtcatccaaaccacttctctccatgatattctgtggcattttgtggcatcactgactcctgcaccagtggaaccagaggaagaagaggatgaagaaaataaaacaagcaaagaaaattcagaacaagagaaagatacaagagtatgtgaacatccactctcagacatagtgattgccggggaagctgctcatcctttaccacacacctttcaccgcttgctgcagaccatctcagaccttatgatgtctctccccagcggcagttcattacagcaaatggccctgaggtgctggagtctcaaattcaagcaatctgatcaccagttccttcatcagagcaacgtctttcatcacattaacaatattttgtcaaagtcagatgatggcgatagtgaagagagttttagcatcagtatacagtctggctttgaagctatgagtcaggaattatgcatagtaatgtgcttaaaggacttaaccagcattgttgacataaaaacttcaagccgacctgccatgattggcagtttgacagacggctccacagaaaccttttgggaatcaggagatgaagataaaaacaaaactaagaacatcaccatcaactgtgtaaaaggaatcaatgcccgctatgtgtctgttcacgtggacaattcccgagatcttgggaataaagttacctcaatgaccttcttaactggcaaagcagtagaagatttgtgcagaataaagcaggttgatctggattccaggcacattggctgggtaacaagtgaacttccaggaggggataatcacatcataaaaattgaattaaaaggcccagaaaatacactgagagttcgacaagtcaaagtcctgggctggaaagatggtgaaagcacaaaaatagctggccagatttcagccagtgtggcccagcagaggaactgtgaagctgagactctgcgagtattcagactgattacgtctcaagtatttggaaagctcatctctggagatgctgaacctacaccagaacaagaggaaaaagcactattgtcatcacctgaaggagaagaaaaagtatacaatgcaacatcagatgctgacctgaaagaacatatggttggaatcatattcagcaggagtaagctgactaacttacaaaaacaggtgtgtgctcatattgtccaagctattcgcatggaagctaccagagtccgtgaagaatgggaacatgctatatcaagcaaagaaaatgccaattctcagccaaatgatgaagatgcctcctctgatgcctactgctttgagctgctctctatggttttagcactgagtggctctaacgttggccggcaatatctggctcaacagctaaccctgcttcaggatctcttctcgctgcttcacacagcctctcctagagtccagagacaggtaacctctttactaagaagagttttgcctgaagtaacccctagtcgtctggccagcatcataggagtgaaatccctccccccagcagatatcagtgatatcattcactcaacagagaaaggagactggaataagctgggtatcttggacatgtttctaggatgcattgccaaagcactcactgtacagctaaaagccaaaggaaccaccatcactggaacagctggtaccactgtgggcaaaggagttacaacagttactcttccgatgattttcaattccagttatctccgacgaggtgaaagtcattggtggatgaagggctcaacccctacccagatctcagagatcatcattaaacttatcaaggatatggcagcaggtcatctgtcagaagcttggtcccgagtgacaaaaaatgctattgcagaaaccatcattgccttgaccaagatggaagaagaatttaggtctccagtgagatgtattgcaacaactagactctggcttgctctcgcatccctatgtgttcttgatcaggaccacgtagatcgtctctcctcggggagatggatgggaaaggatggacaacaaaaacaaatgcctatgtgtgataaccatgatgatggtgaaactgcagcaatcattttatgcaatgtctgtggaaatttatgtacagactgtgacagattccttcaccttcatcgaagaaccaaaactcatcaaagacaggtcttcaaagaagaagaagaagctataaaggttgaccttcatgaaggttgtggtagaaccaaattgttctggttgatggcactggcagattctaaaacaatgaaggcaatggtggaattccgagaacacacaggcaaacccaccacgagtagctcagaagcatgtcgcttctgtggttccaggagtggaacagagttatctgctgttggcagtgtttgttctgatgcagattgccaggaatacgctaagatagcctgtagtaagacgcatccttgtggccatccatgcgggggtgttaaaaacgaagagcactgtctgccctgtctacacggctgtgacaaaagtgccacaagcctgaagcaagacgccgatgacatgtgcatgatatgtttcaccgaagcgctctcggcagcaccagccattcagctggattgtagtcacatattccacttacagtgctgtcggcgagtattagaaaatcgatggcttggcccaaggataacatttggatttatatcttgtcccatttgcaagaacaaaattaatcacatagtactaaaagacctacttgatccaataaaagaactctatgaggatgtcagaagaaaagccttaatgagattggaatatgaaggtctgcataagagtgaagctatcacaactcctggtgtgaggttttataatgacccagctggctatgcaatgaatagatatgcatattatgtgtgctacaaatgcagaaaggcatattttggtggtgaagctcgctgcgatgctgaggctggacggggagatgattatgatcccagagagctcatttgtggtgcctgttctgatgtttccagggctcagatgtgtcccaaacatggcacagactttttggaatataaatgtcgctactgctgttcagtggctgtttttttctgttttggaacaacacatttttgtaatgcttgtcatgatgattttcaaagaatgactagcattcctaaggaagaactaccacactgtcctgcaggtcccaaaggcaagcagttagaaggaactgaatgtccactccatgttgttcatccacccactggggaagagtttgctctgggatgtggagtgtgcagaaatgcccacactttttagaacacgcagatcctttgtctacagagagaaaaattgccttcatcccccaagaggatgcggtgaagtttaaactctgctcaggataaggacgggaccatttttacatccatgaaaatgaaccattcacagtgcaagaaggataccaaataccatgtacataattcttgctatgaaaagtttccccattattttggtttatcttcttttgaacaaatgacatcaaacttgtgaggtgtttgcatgtggccattaccgtcattggcctgtgaagcattggacatttatagataattgatataaaagaatcgccatgcccatggactaagaacgatgctggctttcaagcaaaaaagaaaaataatcattgtttattgtatactgcctttttgtaatcctgtacaattgcatcacgggtggggataaaaagaggaatattctggtttatttcctagactgttatttaaaaaaaaaaaaaacattgtgttaggacagcatataaatgtaataagtatcacactgtatataaacatatcaatgtttgtcctgtataagaattactaaattacaaatgcaatttcatttaaacttctaggttaagtttgagcctgaaattttaatgaagtgcaatactgagtgtgcctcattatcttgcagctgtaaacatattggaatgtacatgtcaataaaaccactgtacatttttatacagtgataaagtcta

SEQ ID NO: 2657 - DNA, 15025 bp, Homo sapiens; identical to SEQ ID NO: 2656

SEQ ID NO: 2658 - DNA, 2850 bp, Homo sapiens
agattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttggaaa

SEQ ID NO: 2659 - DNA, 1485 bp, Homo sapiens
atggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaat

SEQ ID NO: 2660 - DNA, 2871 bp, Homo sapiens
agattcctacttcttacgccccccacatcacccgcctcgagacctcaagggtagaggtgggcacccccgcctccgcacttttgctcggggctccagattgtagggcagggcggcgcttctcggaaagcgaaagccggcggggcggggcgggtgccgcaggagaaagaggaagcgctggcagacaatgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggttggctagaaggccacggggtgggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttgg

SEQ ID NO: 2661 - DNA, 2638 bp, Homo sapiens
atgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccctgaagactgttctgaggccctgggtgtgtgtgtatctgtctgcctgtccatgtacttctgccctgcctcctcctttcgttgtaggaggaatctgtgctctacttacctctcaattcctggagatgccaacttcacagacacgtctgcagcagctggacatcacatttcatgtcctgcatggaaccagtggctgtgagtggcatgtccacttgctggattatcagccaggacactatagaacaggaccagctgagactaagaaggaccagcagagccagctcagctctgagccattcacacatcttcaccctcagtttcctcacttgaggagtgggatggggagaacagagagtagctgtgtttgaatccctgtaggaaatggtgaagcatagctctgggtctcctgggggagaccaggcttggctgcgggagagctggctgttgctggactacatgctggccactgctgtgaccacgacactgctggggcagcttcttccacagtgatgcctactgatgcttcagtgcctctgcacaccgcccattccacttcctccttccccacagggcaggtggggaagcagtttggcccagcccaaggagaccccaccttgagccttatttcctaatgggtccacctctcatctgcatctttcacacctcccagcttctgcccaaccttcagcagtgacaagtccccaagagactcgcctgagcagcttgggctgcttttcatttccacctgtcaggatgcctgtggtcatgctctcagctccacctggcatgagaagggatcctggcctctggcatattcatcaagtatgagttctggggatgagtcactgtaatgatgtgagcagggagccttcctccctgggccacctgcagagagctttcccaccaactttgtaccttgattgccttacaaagttatttgtttacaaacagcgaccatataaaagcctcctgccccaaagcttgtgggcacatgggcacatacagactcacatacagacacacacatatatgtacagacatgtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacacagctgttctctccctctctccttcccagagcaatttatactttaccctcaggctgtcctctggggagaaggtgccatggtcttaggtgtctgtgccccaggacagaccctaggaccctaaatccaatagaaaatgcatatctttgctccactttcagccaggctggagcaaggtaccttttcttaggatcttgggagggaatggatgcccctctctgcatgatcttgttgaggcatttagctgccatgcacctgtccccctttaatactgggcattttaaagccatctcaagaggcatcttctacatgttttgtacgcattaaaataatttcaaagatatctgagaaaagccgatatttgccattcttcctatatcctggaatatatcttgcatcctgagtttataataataaataatattctaccttgg

SEQ ID NO: 2662 - DNA, 1801 bp, Homo sapiens
gctaggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggccccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttata

SEQ ID NO: 2663 - DNA, 5892 bp, Homo sapiens
ggtcggcagcagggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactc

SEQ ID NO: 2664 - DNA, 2337 bp, Homo sapiens
aacaaacaagtgtccgagctggcaggacgacccagcagggtcagccgtgaggaggagggagcagagcgaggtccgtgtgggagacttcctagaggagatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactc

SEQ ID NO: 2665 - DNA, 7681 bp, Homo sapiens
ggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttc

SEQ ID NO: 2666 - DNA, 7834 bp, Homo sapiens
ggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttc

SEQ ID NO: 2667 - DNA, 1557 bp, Homo sapiens
taaaaacctgtgagcttccacccctggctcccccaggactccattgagagcctctgcagtggcagccagaggtttcaaaggtcaccccagctgggcggattagaacaacagatctcccggaccgggtgaagttggctgctcagcggaaggcaaattgcaccatctgcgagcagagtcagaacaaaagccccttaactttttcggtctggccctgggctctgtggcgcccggcactccttcggtctccattcttggctggaccttggacaggaacctctgcagtacggtggtggtgaagtgtggctgcctcgcatcctgactcatgtgagagctgccgaggaagaagctgcggtaagaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtatcgaccagtggacggctagtgcagaacgatccctgcctggtgccgcaccctcctagaggagctgcttgttcactgcgcacctgtgtgtgtatacacctggcccactcacacacccaggcactccccaggggcaggtgagaacttcccaaatctcagaagatgttctcagttgcactattcaaattttaaggtcctcccaacaaacccatgaggtagatcctgtttgaattcctattttactgatggggaagtgaaagcatagagagttgttggagtgtttcatccaatatcactgcattcagcgcagagttgctgcatggccggggaggacctccctaaccaatcccccttcccctcctcctggttcagggaatccaccccctgaagtcatctggctgcacaatgggaatgagatccaagagtcagaggacttccactttg

SEQ ID NO: 2668 - DNA, 10027 bp, Homo sapiens
ggctccccgcgccgcccggtcggcagcagggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaagcatttcttccttctgatggggcaagactctctctggaatggggctcttatgacctacagtcaaacaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaatctttgcagacttctctttctttccatgctaccagttgtaaaggacacagctatatcctggaaatgaaaaacaaacactgtggtgcctagatgtgaagaactggcttatgtggttgtgttttgctatggaacagaatgatttaggaagttcttgtttatataggtagccgaatttacacatttagttcaaaatttctcttgagcatcagcttagtactatatcaatcattctagaaggatatcttatagagcaggtgtccccaacccccggtaagtagcctgttaggaaccaggtcacacataaggaggttagcagtgggcaagtgagcaaagcatcatctatatttacagccgatccccattgctcgcattaccgcctgagctctgcctcctgtcagatcagcggcagcatcaggttctctcaggaacgaactctattgtgaactgctcatgtgagggatctaggtttcacgctccttatgagaatctaacacctgatgatctgtcactgtctcccatcacccctagatgggacagtctagttgcaggaaaacaagctcagggcttccactgattctacattatgatgagttgtatacttattttatattataataaaatatattattacaatgtaataataatagaaataaaatgcacaatacatgtaatgtgcttgaataatcccaaaaccaccccctctcctggtccatggaaaaactgtcttccatgaaagtggtccctggtgccaaaaaggttagggaccactgttacagagtatcaggtcctcaagatgctaaaatctatatgacatttttaacatgtgacattatcatcatcatcatcatcatcatcactgatgatactatttaccagggcatggtttgaattggtgactttggtgcagttcattattggcagccaaatgctttatccataccttcatattgaagaatttgttatcaggaaactaccagtcctgctttacaggaagtctgttatcagatatcagatggcaagttccccatgtcttcagatgttcaaacaatattgtggatggtctagaaagagtttaagacatgctgttaaatgtagggctagataattctctgattctttgatgtagtctggaaagaaacaatccattgtccagttaataaatatttagtgttttcatttttaagacactcacaatccacaaatgtccctaacaatttattatttttaaagaaaatgactttttattccttgctagtgaaaaatgtacaatttatatgctgcactgagaaaaataacagatatactttcttccattcattttcatcccaaacatataaaaaataatccattgattgttccttgcattgcatatcttattaaaagatatttcctacatgcaactaataagacatgctgactgttgtcagctctaaatttatgtaaagattttttatttttgttaaaatgtttgaaatttgctttttgctccacacctcacctgtttttgataaatctgtgctaataagtacataggaggtaataaataattgagttgtgagaaacccaattctccatttttcaagaaaacacaagtagcactactctctttatcccttgggactccttcctgtaatttgaaagggggggctaatgttggtggcagttgttgctaaggatctctgcacagagttagggcttcactctcggcttcctggttagatggggccatgtgactagtcctagtcagtgagctgtgaccagaagtgatgtatgtaccctcgggaccagagcatttatgtgctggtacaagcctctccataatgacgggcaacacatgagatggtggctgctgcagccatctgggtctctagccaacccaaaatggggacataacacaagcaagaaataaacatttgttcttataaatcaccaagattttggggttctcagtggctgcaacataacctagactatcctgatacaggcttatcaccatgttctggatgtgtggtgaccaggatggtagccactactcacaagtggctatttaaatttaagttactttaaaaaataaaataaaaaattcagttcctcagttgtatgagttacatttcaaatgctcgacagtcacatgtacatcacttttcaaattatgtgaaattaaaactgaaaagcttgtgtgaaagtctagagagtatggtctatagtttcatcaattgtattggataatatagtctcgatactcaa

SEQ ID NO: 2669 - DNA, 7282 bp, Homo sapiens
catgaaaggatgtaacacgcaccaagatgtataaactatccggatagttctccatagccatgggtgtgtatggatagaacggacctggtcgcaaccagagttggatgtgattatgaggaaatgctcccaggtgcaggagtttgaattaggtgtggaacctcagtcagaatacagagaagaggactgcacaggtggaggagaaggcacagaggtgggagccggacccattccggctgggcttggctggacaggagcagagtcttttagctggatactcaagggacccaggggcattgagactttgcctgggtggcaaagaaaagggaaatcactgtgttggaggcaactggaacactggtcatttaccacaccaggtgactaaatcacagttgcctcagaaagtagagtgtcactcagaggttgaaagagggagcaaaggcgaatgggggccacaagtgtggagtttaagtgaccaccatcctgagcacatatcagctgtgctcctccaccatggaagtcagttcctggctacacccctcatgggaaggtgggtctccaggcctccctcaagtgcaaggtgagttgaaacatctgtagctgcttaccttttggtgccactaggatctgagtagcaaatattctttttaaaaatgtgggggaggatctacaaagtcaaagtcagctgtattaataatcctgtagccagcaggtctcaaagaaatatttctggaaaggatagggaagctgatgtcagggcggggcagtcctcagagcagtgagtctaagtggatattgcttggctgaggctataggttaaggggcagccttatcacctgggaacatctgcagatgaactaaagccaggaggatgcctaaacccaggggctaggagcagagaagagatgaggaaacaggagaggaggcaaagggaatttttcagttaaatcagtcagggaatcatagtggtgctgatttttttttttttttttaaagagacagggtctcatgctgtcacccaggctggagggcaatggtacaatcatagcttactgcagtctcaacctcgtgggctcaagcaatcttctcgactcggcctcctgagtagctgggactacaggcatatgccaccagaccggctaatatttttttttctcctttggtagaaacagggtctcactatgttgcctagactagtcttgaactcctggcctcaagcgatgctgctgcgttggctgcccgaagtgttgagtgcccagcctatgctgatattttaatcaatttttttttcttcttgtttacggcattattagccatagggttttctggaagggcgggggaagaaaagggtagaattcagagaatgaaccttaattttatattttagtatagatggcgacatttggaaatgatttttccacaaaattgcacacaaaagttgtccacaaaaattccattcaacaagtagtttccctgaagagtagcttccctggtaacagctctaaccatttcatgttacgttgctccctcaggaaaacgttttctgcattttaactgcaatcaccagggccttagctccccttggaatatgagggttccctcttgcagcagccaaggttctgtgcagtggggtggagtgggctgtgggcgggggcagagggagaggggaagatcaggctcaggtggcccagaactctctgcagctgtgccagagaaggcaccttcttgttattctggtgtggttttcataaaaagccctagaaggaatgaagtgacatgggaacaaatccctacaagcaaagctaggctgggtatagatgactaatcatattactcatcttggaatcaagttattccgaaagaaggtatattttaaatttatattaaaagaattttacaaagatatgttggaaaggtgtagcaatgggggcaggtaggttgagcagattaacagggtttccgcatgcacactggaagcaaaagactagacatcagaggcccttaggtagccatctttattttctgggaaccataaagaccccagcagtatggaccaagggcattaggggagaaaacactggactcagtatagcacggagtattcttggccatcccatttggatggtatgcactgctcaggggaaactgtagtcttggggctactggtatatatggggggctttgatgggtaaccagcttgctgtatgtatgtcagggaatgtcttagtattggtgccaaaagaccctaatcctgggaaactccacaagcctgcctgggcaagccaggatggctggccccacaagctctccaaggggcagggaatttgtgctgcatgaaggaggctggtgcagatactgctcaccagcgacacaggaacccagcctgggcaattgccctcaagcaagaaaaagggagaaattacaaaatcaaaacttggcgatcttgatgttccaaaaatttccaaaggtctttggtcagtaaagcaacaaccaattgtcagctcaaaggcataaaactggaagactagaacatactgatatattcatttctagttctgacaaataacttcctcggcaattttttttcacaaatcaattcccaaatatttttctatgttttagaaattatatgctggatatctccatcttttagaaaagttctccctatgtgagacatatttatttgttaatatatttactacttcctctgaaatactataactcttttgtttcctcattctgatagcttcattttagtcattttgttatgaaataaaatctggaagaaaaaagacatcgtctcgccacaccacacaggtgaagacagtcctcatcagtcccaatcctgatgtctggaattggggagcccatgggctcaaggcgggtgttccttgctacacatttatggatataaaccagagtcgttctgtagaggtctggaactgcaggaagattagaatcttctgctcccaggctactgaggcccagagaggggaactgacttgcacaaggtctcccagcaattagggttagagaactaacctgtcccttgttgggaatgaaccctctgggtttagaggctcctagcccaggacaaaccaatctgtgttggataaagggaatggagagcagagaagggccgagtctgagaatcgggttgattaggaagcaggctggtctgacattgactacgtagggagggctgccatggctggtaccacctcttacctgttcctgagggcagggtaacctcccatgggaagagctgggtctctctctctctacactttgtctagcacaacaaacaggttgaaccagtaacatctcccagaagagcatgaaaggttgccacgtggcctgagcctgcagaggcattctccgcagggccacacggtggttctgcgcacagttaagttgttcagttttcatctctcaccatcttcccctcctcatcacctccacctggggctgcgtggattctgttcagcgacccagcctcactgtggtggcagaggccagaaacatacccacaccatacagtgtgatgtgtgtgagaagggatggccaggggacagagcaaggtgaaatgtctgtccaaagtgcatgagagcagtctgcagcaaggatggcaggaggcatgacagtaaggtcatcccgctcactgcagtaggtctcctctttaaccatacacacacgcacacaattttctgtatgtttccttagcacccagaagttattcactttcaaaatgatcagtctttttactgaagcttactggctttccaactagtcctaaattgtgaggctttactgaagtacttgagcatgtgaagtgaactgaggaggaaaatggctttgccggcagagtttgagatgcaacgagtacaagccatttgcctatgaagaggctgtttcctccctctctcagggaggacaagtagccagtctgtggtgacatctgttgtctagatgcacagcttttcgatgcctaaaaaagatgctttgggtgcaggggtggaaagacttggttgtgccttagttttcttatcttagtcattcctgttaaccttagaaaaaaggtgaaaaacttactgaaagataagaaacaataagacacaattgtacattattagggatcctatgcttggtagaattttcgcaatgtaaataaattacatctcaagttctgatccttttcagcagaaattctttcctctcccaagtctagtcactgagaagcaaagtgccgttgccttttatttcttcaatgcttctttttggtgcctgaatgcacaccaaggaagagctcctctccagagcttcactgcatcatagacttgtgcaggggccagccagagtgtttctcaaaatcttttaagtctctgaattataaacagagctaaatgggaccttggagatcatcttgtccagccccctcctagagaaggagactgaagctcagagtggttaagtgacttgcccaaggtcaacaggatgctgtgttattattattatgattatttttgcatcaggacttgtgggatctgtagtaactattctcttggccaattataatcacatcactggcattgttttacgagaaatagccccgctaggcccagtcagcaataagtctttggagctgtctcagcctgcagttgctttatataaaccatcccttttatgggagttgaagcactgtatgaaaagggtttttgtctcatgttgaccttgtttagtcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgca

SEQ ID NO: 2670 - DNA, 5745 bp, Homo sapiens
atgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtga

SEQ ID NO: 2671 - DNA, 7669 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaacggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgactcctcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccatcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaacgtggaa

SEQ ID NO: 2672 - DNA, 7762 bp, Homo sapiens
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctcaggaatcgcctaaaccagtgaaacaccagggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgagattcagaatattcagagagcttctttctatgacagtgtttctggtcttcatgagccaccagtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaacggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgactcctcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccatcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaacgtggaa

SEQ ID NO: 2673 - DNA, 7667 bp, Homo sapiens
actgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctcaggaatcgcctaaaccagtgaaacaccaggcaagtgctcttctttatggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaacggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgactcctcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccatcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaa

SEQ ID NO: 2674 - DNA, 7682 bp, Homo sapiens
actgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgagattcagaatattcagagagcttctttctatgacagtgtttctggtcttcatgagccaccagtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaacggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgactcctcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccatcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaa

SEQ ID NO: 2675 - DNA, 732 bp, Homo sapiens
ctgaggcgctggatctgtggtcgcggctggggacgtgcgcccgcgccaccatcttcggctgaagtaactgagggcaaacccatcagacaaccagagccataatttgtggtcaccgctgaaatttaccttggaaactcgaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatac

SEQ ID NO: 2676 - DNA, 7501 bp, Homo sapiens
gagggcggggcgggaaggcggcgaggagccgagctgggtgcggtgaggcgcgcagatcaccgcggttcctgggcagggcacggaaggctaagcaaggctgacctgctgcagctcccgcctcgtgcgctcgccccacccggccgccgcccgagcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggctctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgct

SEQ ID NO: 2677 - DNA, 6179 bp, Homo sapiens
gagggcggggcgggaaggcggcgaggagccgagctgggtgcggtgaggcgcgcagatcaccgcggttcctgggcagggcacggaaggctaagcaaggctgacctgctgcagctcccgcctcgtgcgctcgccccacccggccgccgcccgagcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacga

SEQ ID NO: 2678 - DNA, 7503 bp, Homo sapiens
gagggcggggcgggaaggcggcgaggagccgagctgggtgcggtgaggcgcgcagatcaccgcggttcctgggcagggcacggaaggctaagcaaggctgacctgctgcagctcccgcctcgtgcgctcgccccacccggccgccgcccgagcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggctctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggcccgaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacga

SEQ ID NO: 2679 - DNA, 789 bp, Homo sapiens
aggggctggtgttcggggctgccccgagcccagctctgggagcttattttgtcatcacagtggcactgtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccaggaggcctattttaaaaacagagctgtgaggttaggagttctctagctgtgcttttccatctctgaatttgcagtaaaatccatttcccaag

SEQ ID NO: 2680 - DNA, 449 bp, Homo sapiens
ggggctggtgttcggggctgccccgagcccagctctgggagcttattttgtcatcacagtggcactgcagcctgtctacctcctggctgcggctcgtcctcagatgccttctgtgaaggctgtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggag

SEQ ID NO: 2681 - DNA, 1199 bp, Homo sapiens
gcccccgcctggagtccagacccgacggccggcccagttccacgcacccagcgagcccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcttc

SEQ ID NO: 2682 - DNA, 1024 bp, Homo sapiens
gtccagacccgacggccggcccagttccacgcacccagcgagcccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctgggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcttc

SEQ ID NO: 2683 - DNA, 1330 bp, Homo sapiens
aggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttgggta

SEQ ID NO: 2684 - DNA, 1163 bp, Homo sapiens
gaccaaagggtgcggctgctgcagaggtggctgatgcaggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttggg

SEQ ID NO: 2685 - DNA, 860 bp, Homo sapiens
aggggcggatcctggggcttcctccctctagaccaaagggtgcggctgctgcagaggtggctgatgcagtggtggactaggaggactactggaagacagaaggccagcaagtagattgggtcggctgttttatagacctggtggttacagaccccctgtgaggggaggtcctgaggaggacaaatttgtagccagagcaggctggggccaggactcctaggttctgccccagccttaagcagctcatccatcactcccagcctccctccaatgtggggtagacacctggatctatctgccctgctctataggggatgggtctcttccaggtcacctgtgctatcaggtgagtgtgggacaaagtgcagcccaccactccccagttccagtatgcatggtcccccctgcactctgtcagcccttccctgctccaaccccaccctccctcctggcacagcccagcatggctgttatctacaggaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctg

SEQ ID NO: 2686 - DNA, 1464 bp, Homo sapiens
aaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaata

SEQ ID NO: 2687 - DNA, 1820 bp, Homo sapiens
cggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacattggtggactaggaggactactggaagacagaaggccagcaagtagattgggtcggctgttttatagacctggtggttacagaccccctgtgaggggaggtcctgaggaggacaaatttgtagccagagcaggctggggccaggactcctaggttctgccccagccttaagcagctcatccatcactcccagcctccctccaatgtggggtagacacctggatctatctgccctgctctataggggatgggtctcttccaggtcacctgtgctatcaggtgagtgtgggacaaagtgcagcccaccactccccagttccagtatgcatggtcccccctgcactctgtcagcccttccctgctccaaccccaccctccctcctggcacagcccagcatggctgttatctacaggaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggt

SEQ ID NO: 2688 - DNA, 765 bp, Homo sapiens
agtcgttcgtttccagaccatgccgagccacacctgcccacagagtcgagctctcgaagtcctcattcccaaaagctccacagcctgtgacccactaggagggagggggaaaccgaggcccgggagagacggagaagccactctctgaggaccccggagccccgcccacagtgggtggggtcggcactgaaggggttaaggccgcggggaagccccgggctcagccctaggggcggatcctggggcttcctccctctagaccaaagggtgcggctgctgcagaggtggctgatgcaggaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagcc

SEQ ID NO: 2689 - DNA, 583 bp, Homo sapiens
aggggcggatcctggggcttcctccctctagaccaaagggtgcggctgctgcagaggtggctgatgcagtggtggactaggaggactactggaagacagaaggccagcaagtagattgggtcggctgttttatagacctggtggttacagaccccctgtgaggggaggtcctgaggaggacaaatttgtagccagagcaggctggggccaggactcctaggttctgccccagccttaagcagctcatccatcactcccagcctccctccaatgtggggtagacacctggatctatctgccctgctctataggggatgggtctcttccaggtcacctgtgctatcaggaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccag

SEQ ID NO: 2690 - DNA, 1784 bp, Homo sapiens
tgccaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctccc

SEQ ID NO: 2691 - DNA, 2122 bp, Homo sapiens
cggccccccgcattccccgcccccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgtta

SEQ ID NO: 2692 - DNA, 2127 bp, Homo sapiens
atcctctccccaccccccgcctgcccgcgatcgccctctatttatagcggccccccgcattccccgcccccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgtta

SEQ ID NO: 2693 - DNA, 2047 bp, Homo sapiens
tctccccaccccccgcctgcccgcgatcgccctctatttatagcggccccccgcattccccgcccccacctccccgccttgttgtccaacttctcccggagcagccggagagcaggcgtcgggacgcagcaaagagaggagaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 2694 - DNA, 2096 bp, Homo sapiens
actcctgcgccctcgacgttcccccgtgccccctttcggcgccagcacacctgcccctgccagccggcgagacccccgcctcctcagcggcggtcccgcccacctcctcctttcttaatctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctga

SEQ ID NO: 2695 - DNA, 2084 bp, Homo sapiens
attgaccccagagtccctgttggccatcctctccccaccccccgcctgcccgcgatcgccctctatttatagcggccccccgcattccccgcccccacctccccgccttgttgtccaacttctcccggagcagccggagagcaggcgtcgggacgcagcaaagagaggagaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 2696 - DNA, 2022 bp, Homo sapiens
gggtctgcgggaagcccgagccggggcgggcccgagtcaaaggcaagtgaaggtggaagcggccgcggcggcagcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 2697 - DNA, 2079 bp, Homo sapiens
aagcccgagccggggcgggcccgagtcaaaggcaagtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 2698 - DNA, 1915 bp, Homo sapiens
agtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 2699 - DNA, 1954 bp, Homo sapiens
agtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 2700 - DNA, 2054 bp, Homo sapiens
cggccccccgcattccccgcccccacctccccgccttgttgtccaacttctcccggagcagccggagagcaggcgtcgggacgcagcaaagagaggagaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgtt

SEQ ID NO: 2701 - DNA, 1500 bp, Homo sapiens
ctcaccgggttggggacagggatggaaaatggtggttccatgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaa

SEQ ID NO: 2702 - DNA, 639 bp, Homo sapiens
gtggggtgtcagtatcccggaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattggg

SEQ ID NO: 2703 - DNA, 2162 bp, Homo sapiens
ggcggcagcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttgggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 2704 - DNA, 943 bp, Homo sapiens
ttttggtaccctgtcctttagaatactcagtcactgagctacaagtttcactccctacctgagagtgtggggtggcccctaaatatagcccgagaaatctgagctacacttctgccccaccctggtattttggtccagggcagaggagggaggggtctggaggtgtggtgttgagggtggcagtggggatggtgagtatcaagagaagggctgtcctgattcctcttccaaagcttccaccgatcagcctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcc

SEQ ID NO: 2705 - DNA, 848 bp, Homo sapiens
gcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcacc

SEQ ID NO: 2706 - DNA, 595 bp, Homo sapiens
aatgttgaacttgcggagtttattcagagttgggaggaagggtcttgggaggaagggaggcattgggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcc

SEQ ID NO: 2707 - DNA, 1980 bp, Homo sapiens
gggtctgcgggaagcccgagccggggcgggcccgagtcaaaggcaagtgaaggtggaagcggccgcggcggcagcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 2708 - DNA, 565 bp, Homo sapiens
accccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcct

SEQ ID NO: 2709 - DNA, 554 bp, Homo sapiens
agcaaagagaggagaggtaccaggactctgggcacgagggagtcggaactcctgcgccctcgacgttcccccgtgccccctttcggcgccagcacacctgcccctgccagccggcgagacccccgcctcctcagcggcggtcccgcccacctcctcctttcttaatctagttctctgtgttcgggcggggggagtcgaactcgtggggtgtcagtatcccggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgagg

SEQ ID NO: 2710 - DNA, 583 bp, Homo sapiens
cccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatccct

SEQ ID NO: 2711 - DNA, 587 bp, Homo sapiens
atattgattccggctcgagcctagagaggacgtgttctctggacttaggggtagacagacactggggaggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctgga

SEQ ID NO: 2712 - DNA, 561 bp, Homo sapiens
aagtgaaggtggaagcggccgcggcggcagcagaccccagagtcagaaggagtgagaaccctgacccctaatcccactgcatccagccaataggagcccagtaagtgaccccaccccgcaggctgcaggctccttcctgtgcaggtctgtccaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctgg

SEQ ID NO: 2713 - DNA, 573 bp, Homo sapiens
agggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggacc

SEQ ID NO: 2714 - DNA, 632 bp, Homo sapiens
cttgtagcctatattgattccggctcgagcctagagaggacgtgttctctggacttaggggtagacagacactggggagggttagtgacccgaggaggttgatgaccctgggagtctgggtcttggctgaggctttccgtccctgaaagaccccaggtctgtctcccatgtcattcacctcgttgctgtgttttctcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtac

SEQ ID NO: 2715 - DNA, 571 bp, Homo sapiens
agggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcat

SEQ ID NO: 2716 - DNA, 578 bp, Homo sapiens
agcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttgggaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaa

SEQ ID NO: 2717 - DNA, 609 bp, Homo sapiens
agcgcccgtgggcgggctggggcgggccgggggcgggtctgcgggaagcccgagccggggcgggcccgagtcaaagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcc

SEQ ID NO: 2718 - DNA, 2216 bp, Homo sapiens
agggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 2719 - DNA, 775 bp, Homo sapiens
agcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccgga

SEQ ID NO: 2720 - DNA, 578 bp, Homo sapiens
aggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattgg

SEQ ID NO: 2721 - DNA, 924 bp, Homo sapiens
cgcggcggcagcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttgggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaat

SEQ ID NO: 2722 - DNA, 871 bp, Homo sapiens
ctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacag

SEQ ID NO: 2723 - DNA, 2880 bp, Homo sapiens
gtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaaggtccggggcgcttggcaccggccacgcaagggtgtcagtctccacgcggacgggctgcgtagggactcgtagggacgggttccgggtgctgggcccggccggtctcctctgtcctacccatcccttcccgatggcgcttgccttcgcgggccgtcgggggagaacgggagaagattgtgggaccgctctcctctccctttctccactcgtgggacctacacggagactgagtagaggagagaagcgacggcaccaatctttgtgtttgtttttaaattgtggagggaaacagccatgctctgctaccctcctcttactggagagctgtcaaaaattttggggatcccctattcccccgcgtttagtccccctgcagatagaaaattgaggccaaatgtagtaactaactggggcaaggtcacactgggagtggcagagccgggattcgaatccggaggttctgacagggccaccctcttacctccacatcagcacttccttctctcctccgcgcagcctgaactgatgcccttgtagcctatattgattccggctcgagcctagagaggacgtgttctctggacttaggggtagacagacactggggagggttagtgacccgaggaggttgatgaccctgggagtctgggtcttggctgaggctttccgtccctgaaagaccccaggtctgtctcccatgtcattcacctcgttgctgtgttttctcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 2724 - DNA, 611 bp, Homo sapiens
aagcccgagccggggcgggcccgagtcaaaggcaagtgaaggtggaagcggccgcggcggcagcagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctct

SEQ ID NO: 2725 - DNA, 671 bp, Homo sapiens
agcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaat

SEQ ID NO: 2726 - DNA, 635 bp, Homo sapiens
cttaatctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataatt

SEQ ID NO: 2727 - DNA, 580 bp, Homo sapiens
gtcctacccatcccttcccgatggcgcttgccttcgcgggccgtcgggggagaacgggagaagattgtgggaccgctctcctctccctttctccactcgtgggacctacacggagactgagtagaggagagaagcgacggcaccaatctttgtaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtac

SEQ ID NO: 2728 - DNA, 583 bp, Homo sapiens
gagtcaaaggcaagtgaaggtggaagcggccgcggcggcagcagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataat

SEQ ID NO: 2729 - DNA, 603 bp, Homo sapiens
gttttggtgagccgagcagagcctggaagcgtccagccgcccgcccctcgccccccggccccagcacaaccctttcctgagcggcagtctgggcgggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaacc

SEQ ID NO: 2730 - DNA, 583 bp, Homo sapiens
atattgattccggctcgagcctagagaggacgtgttctctggacttagggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcc

SEQ ID NO: 2731 - DNA, 851 bp, Homo sapiens
ctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaa

SEQ ID NO: 2732 - DNA, 593 bp, Homo sapiens
atattgattccggctcgagcctagagaggacgtgttctctggacttaggggtagacagacactggggaggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaa

SEQ ID NO: 2733 - DNA, 571 bp, Homo sapiens
gaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataatt

SEQ ID NO: 2734 - DNA, 633 bp, Homo sapiens
tagcgcccgtgggcgggctggggcgggccgggggcgggtctgcgggaagcccgagccggggcgggcccgagtcaaaggcaagtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttg

SEQ ID NO: 2735 - DNA, 2964 bp, Homo sapiens
gctgctgcactgacggcgggtgcccgcgcctcagagttactgatttattcttgagattcctctactctcgttatctgacctcatggatgaacttcaggatgttcagctcacagagatcaaaccacttctaaatgataagaatggtacaagaaacttccaggactttgactgtcaggaacatgatatagaaacaactcatggtgtggtccacgtcactataagaggcttacccaaaggaaacagaccagttatactaacatatcatgacattggcctcaaccataaatcctgtttcaatgcattctttaactttgaggatatgcaagagatcacccagcactttgctgtctgtcatgtggatgccccaggccagcaggaaggtgcaccctctttcccaacagggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttcagacagactgtttgctttctgctgagataaggaatgcatcactctgccagagtatgactttttacagattattaaataaagctgcatatgtctcattgttacctga

SEQ ID NO: 2736 - DNA, 2917 bp, Homo sapiens
gacggcgggtgcccgcgcctcagagttactgatttattcttgagattcctctactctcgttatctgacctcatggatgaacttcaggatgttcagctcacagagatcaaaccacttctaaatgataaggaacatgatatagaaacaactcatggtgtggtccacgtcactataagaggcttacccaaaggaaacagaccagttatactaacatatcatgacattggcctcaaccataaatcctgtttcaatgcattctttaactttgaggatatgcaagagatcacccagcactttgctgtctgtcatgtggatgccccaggccagcaggaaggtgcaccctctttcccaacagggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttcagacagactgtttgctttctgctgagataaggaatgcatcactctgccagagtatgactttttacagattattaaataaagctgcatatgtctcattgttacctga

SEQ ID NO: 2737 - DNA, 2098 bp, Homo sapiens
tcagagttactgatttattcttgagattcctctactctcgttatctgacctcatggatgaacttcaggatgttcagctcacagagatcaaaccacttctaaatgataagaatggtacaagaaacttccaggactttgactgtcaggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgca

SEQ ID NO: 2738 - DNA, 1332 bp, Homo sapiens
actgacggcgggtgcccgcgcctcagagttactgatttattcttgagattcctctactctcgttatctgacctcatggatgaacttcaggatgttcagctcacagagatcaaaccacttctaaatgataaggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgc

SEQ ID NO: 2739 - DNA, 1340 bp, Homo sapiens
atgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccacgtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcagggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcaaaggctacgggtcagagagcggggaggaggactttgctgcctttcgagcctggctgcgctgctatggcatgccaggcatgagctccctgcaggaccggcatggccgtaccatctggttccagggggatcctggaccgttggcacccaaagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttg

SEQ ID NO: 2740 - DNA, 1896 bp, Homo sapiens
ctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcagggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcaaaggctacgggtcagagagcggggaggaggactttgctgcctttcgagcctggctgcgctgctatggcatgccaggcatgagctccctgcaggaccggcatggccgtaccatctggttccagggggatcctggaccgttggcacccaaagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 2741 - DNA, 1797 bp, Homo sapiens
cgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggcaagtggcaaagcagggagggcggaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcagggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcaaaggctacgggtcagagagcggggaggaggactttgctgcctttcgagcctggctgcgctgctatggcatgccaggcatgagctccctgcaggaccggcatggccgtaccatctggttccagggggatcctggaccgttggcacccaaagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaa

SEQ ID NO: 2742 - DNA, 2671 bp, Homo sapiens
gcgggctgcgtagcggtgctgggtcgggccgacgtgccacccacccggagccggtgagtgcagccgcccgccctccggtagatctgcggcctggcggagaagtcgggaggggacaggaagggagggcgggccccgggccctcctccgtctcagccgcctgcggaggtgctgcccacgcctggaggcccccactgaccctcagacccgcgtctgcgcccctctccccgcaccccgaggcagagttgggaaagcagtggtcttagaccccccacctcgggcactcggaagagaacggcggagacaacccctcctcttccctggctggcgcagcgccagcctcgagctcctcggtagcccccgggcagggagggccggagggtgggcgcggcatcttcagcgactcttcgaagtcccttccgcgtctcatctttcaaggctgttgcagaggcggcttgcttcccacctgtccatctccataaaaatccctaaacgaaacatgcccacgtgtccggagattttcaggacttggtgcatttcagatgaaggcttttccagaagcttccccgtagaagaggatcaggcatccaactggttaagggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagtgtgggtcagaggtgccagtagtataatattcgtctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcggtcgtggagcagggagctgcgccttcctggggtgcccggtggtgtgtagagaaaagctgcttgtttactccttaagtcaatgtattggtgactgttgatttgttgaacaattcaggaatcaagggctgtggagaaactccctcatgttgttggcaacaggtgaatgaacctagagcggtgacatgaaaataaagctcactgttactcgct

SEQ ID NO: 2743 - DNA, 2026 bp, Homo sapiens
atgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagtgtgggtcagaggtgccagtagtataatattcgtctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcggtcgtggagcagggagctgcgccttcctggggtgcccggtggtgtgtagagaaaagctgcttgtttactccttaagtcaatgtattggtgactgttgatttgttgaacaattcaggaatcaagggctgtggagaaactccctcatgttgttggcaacaggtgaatgaacctagagcggtgacatgaaaataaagctcactgttactcgc

SEQ ID NO: 2744 - DNA, 2016 bp, Homo sapiens
gaaatctccgcccccagctggagcggctgtgcgggctgcgtagcggtgctgggtcgggccgacgtgccacccacccggagccggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagtgtgggtcagaggtgccagtagtataatattcgtctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcggtcgtggagcagggagctgcgccttcctggggtgcccggtggtgtgtagagaaaagctgcttgtttactccttaagtcaatgtattggtgactgttgatttgttgaacaattcaggaatcaagggctgtggagaaactccctcatgttgttggcaacaggtgaatgaacctagagcggtgacatgaaaataaagctcactgttactcgc

SEQ ID NO: 2745 - DNA, 2128 bp, Homo sapiens
gtgcgggctgcgtagcggtgctgggtcgggccgacgtgccacccacccggagccgggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagtgtgggtcagaggtgccagtagtataatattcgtctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcggtcgtggagcagggagctgcgccttcctggggtgcccggtggtgtgtagagaaaagctgcttgtttactccttaagtcaatgtattggtgactgttgatttgttgaacaattcaggaatcaagggctgtggagaaactccctcatgttgttggcaacaggtgaatgaacctagagcggtgacatgaaaataaagctcactgttactcgc

SEQ ID NO: 2746 - DNA, 2323 bp, Homo sapiens
gccgagccgggaaatctccgcccccagctggagcggctgtgcgggctgcgtagcggtgctgggtcgggccgacgtgccacccacccggagccggctgttgcagaggcggcttgcttcccacctgtccatctccataaaaatccctaaacgaaacatgcccacgtgtccggagattttcaggacttggtgcatttcagatgaaggcttttccagaagcttccccgtagaagaggatcaggcatccaactggttaagggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagtgtgggtcagaggtgccagtagtataatattcgtctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcggtcgtggagcagggagctgcgccttcctggggtgcccggtggtgtgtagagaaaagctgcttgtttactccttaagtcaatgtattggtgactgttgatttgttgaacaattcaggaatcaagggctgtggagaaactccctcatgttgttggcaacaggtgaatgaacctagagcggtgacatgaaaataaagctcactgtta

SEQ ID NO: 2747 - DNA, 998 bp, Homo sapiens
aaatctccgcccccagctggagcggctgtgcgggctgcgtagcggtgctgggtcgggccgacgtgccacccacccggagccggctgttgcagaggcggcttgcttcccacctgtccatctccataaaaatccctaaacgaaacatgcccacgtgtccggagattttcaggacttggtgcatttcagatgaaggcttttccagaagcttccccgtagaagaggatcaggcatccaactggttaagggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagt

SEQ ID NO: 2748 - DNA, 2408 bp, Homo sapiens
agacgcgcgcgagatttgaatttcctctgcgtgcggtcagtgcccgcgcagcgttgagttgcacagcggtattctcaccaggccctgcaatcggtgggccacagtgccggccacagagatggtggaaggaccaggctgtactctgaatggagagaagattcgcgcgcgggtgctcccgggccaggcggtgaccggcgtgcggggaagcgctctgcggagtctgcagggccgcgccttgcggctcgcagcctccacggttgtggtctccccgcaggctgctgcactgaataatgattccagccagaatgtcttgagcctgtttaatggatatgtttacagtggcgtggaaactttggggaaggagctctttatgtactttggaccaaaagctttacggattcatttcggaatgaaaggcttcatcatgattaatccacttgagtataaatataaaaatggagcttctcctgttttggaagtgcagctcaccaaagatttgatttgtttctttgactcatcagtagaactcagaaactcaatggaaagccaacagagaataagaatgatgaaagaattagatgtatgttcacctgaatttagtttcttgagagcagaaagtgaagttaaaaaacagaaaggccggatgctaggtgatgtgctaatggatcagaacgtattgcctggagtagggaacatcatcaaaaatgaagctctctttgacagtggtctccacccagctgttaaagtttgtcaattaacagatgaacagatccatcacctcatgaaaatgatacgtgatttcagcattctcttttacaggtgccgtaaagcaggacttgctctctctaaacactataaggtttacaagcgtcctaattgtggtcagtgccactgcagaataactgtgtgccgctttggggacaataacagaatgacatatttctgtcctcactgtcaaaaagaaaatcctcaacatgttgacatatgcaagctaccgactagaaatactataatcagttggacatctagcagggtggatcatgttatggactccgtggctcggaagtcggaagagcactggacctgtgtggtgtgtactttaatcaataagccctcttctaaggcatgtgatgcttgcttgacctcaaggcctattgattcagtgctcaagagtgaagaaaattctactgtctttagccacttaatgaagtacccgtgtaatacttttggaaaacctcatacagaagtcaagatcaacagaaaaactgcatttggaactacaactcttgtcttgactgattttagcaataaatccagtactttggaaagaaaaacaaagcaaaaccagatactagatgaggagtttcaaaactctcctcctgctagtgtttgtttgaatgatatacagcacccctccaagaagacaacaaacgatataactcaaccatccagcaaagtaaacatatcacctacaatcagttcagaatctaaattatttagtccagcacataaaaaaccgaaaacagcccaatactcatcaccagagcttaaaagctgcaaccctggatattctaacagtgaacttcaaattaatatgacagatggccctcgtaccttaaatcctgacagccctcgctgcagtaaacacaaccgcctctgcattctccgagttgtggggaaggatggggaaaacaagggcaggcagttttatgcctgtcctctacctagagaagcacaatgtggattttttgaatgggcagatttgtccttcccattctgcaaccatggcaagcgttccaccatgaaaacagtattgaagattggacctaacaatggaaagaatttttttgtgtgtcctcttgggaaggaaaaacaatgcaattttttccagtgggcagaaaatgggccaggaataaaaattattcctggatgctaatatctgtagattctctggcatttagtctcttcaaactgtgtataatgtttggtcctcctctgtttcatagaaaagtcatagaatatctatgatacattgaaaagttactgcaatatttgagaactgttctttttttttcttgtgtgtgccatctttccattgttggctacgtcttttcttttgccttgatgaacgttctatgtatttcatcggatatacagcatattccatttaggatgtgtatttaatgcatttagtaatgacgataaagtgtttttagtatgcttttagtctcttgtaactggggagaagcagtgttttttttttaggaaaggattatgcgacacaataaaataagatattctgtctgtagtgaatacatttctcatgtactaacactatttataatatatgattaaagatatttcttgttttattaaataataagaaataagatctcctttatgaacaa

SEQ ID NO: 2749 - DNA, 1986 bp, Homo sapiens
gaggacgcgccaacatccccgctgctgtgctgggcccggggcgtgcccgccgctgctcccacctctgggccgggctggggccgcccgggggccctgttcctcggcattgcgggcctggtgggcagagccgcggagagggcttcttttccccaagggcagcgtcttggggcccggccactggctgacccgcagcggctccggccatgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggccactgcccgggaatcccacgcctgcctcgcttgctcctgcaacggccatgcccgccgctgccgcttcaacatggagctgtaccgactgtccggccgccgcagcgggggtgtctgtctcaactgccggcacaacaccgccggccgccactgccactactgccgggagggcttctatcgagaccctggccgtgccctgagtgaccgtcgggcttgcagggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttaagacccctatccctggacccactgaggacagcagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcctgagcccgccggctgggcagggcggccgctgctcccacatcta

SEQ ID NO: 2750 - DNA, 5571 bp, Homo sapiens
ttgttttgttttgttttttcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtcccaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttc

SEQ ID NO: 2751 - DNA, 1995 bp, Homo sapiens
attacaattcgtgatgagatttgggttttgttttgttttgttttttcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaggccccacctcctacggcatctgctagctcgtctacccctgttccattgtctccaccagatacaacttggcctcttcctgcccttgcaaccacagaaccagctaaaaacattgcacagaatcactgctgtaacatgttccaagctggtcttcataatgctctaatgaagtaa

SEQ ID NO: 2752 - DNA, 1182 bp, Homo sapiens
cagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagatacaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagca

SEQ ID NO: 2753 - DNA, 4449 bp, Homo sapiens
gaaacgtcccgtgtgggaggggcgggtctgggtgcggcctgccgcatgactcgtggttcggaggcccacgtggccggggcggggactcaggcgcctggggcgccgactgattacgtagcgggcggggccggaagtgccgctccttggtgggggctgttcatggcggttccggggtctccaacatttttcccggctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataa

SEQ ID NO: 2754 - DNA, 731 bp, Homo sapiens
gatgcaggctgggtgtggagggtgcgagtaggctggagtacaccagggagttcccagcaggccactaggagccacccaggatgcccggcaacctcatgagtcagacaagcagggctgtgtctatctggaagtttccagccaagctaggtaaaacacatggacacagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactga

SEQ ID NO: 2755 - DNA, 2172 bp, Homo sapiens
tcctgcgcacccggagggagaggccgcgcgcgcccgcccgctctttctgcgcgcggccctccccgctgcccccgccctcgcgccctgtttggagggagccaccctgacgtcggagccgctcccccgcgccgcgcgcccgcccggggccgcagacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggcccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgccagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgcc

SEQ ID NO: 2756 - DNA, 528 bp, Homo sapiens
gtttacaagcggcggcaaagggggcagccgcctgccttggcgtggccggaggttggcgggcatcaagggagaaagccacacttccaggctttcggaggccctcgctccccaagctggacgccaccagcctgtaactaggggcaccccaggaaaacagagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgca

SEQ ID NO: 2757 - DNA, 573 bp, Homo sapiens
caaacgctgcgtgctcgttgtgcatgcggactgtggtgtcacctgaatgctgagcccacagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagc

SEQ ID NO: 2758 - DNA, 546 bp, Homo sapiens
cttttgcttgttttcattctatttctccagcgagagtgcagaggtttggacccccgttgaggccagactgacaggattagaggaaacagctgggctgagtccgtgccctgcaggagggagctcacattcccggactctgggagagagcagctccccacagctcagtcacattccagggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcac

SEQ ID NO: 2759 - DNA, 588 bp, Homo sapiens
actaggataacactaggcaaggctgagcaacccaggctaccaacagcacggacttgaaccgggtcgcatgccggagcggacgggatgaggtgcaccgcagaactggggactcctggtgccgggacgcggcgggctggggcgccccactctcggggcaagtctgcaatgcccggtgcccacaaaaaggacacatccatctttgtcaccccgaggcctggcacggcctgacggcccaggctcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggaca

SEQ ID NO: 2760 - DNA, 622 bp, Homo sapiens
gtaaagcaaaatccccaagtcctacaatcgtgtcccagtggtgtccctgggccaccactttccagaagcaaagttattttctcaccccgttgttaagcacacagaatagagaaggtacggccgcaatccacccaagtgcccactgattagataggaacccccgaggtgaggctggaagctggggccaggagctccactcttcccaggagtcagagaaggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtca

SEQ ID NO: 2761 - DNA, 2021 bp, Homo sapiens
gacagcgcgcagcgcagcccagccgagcgtcgcggggccgccccccgccctgccggccgcctcgccgagcctcctggggcgcccgggcccgcgacccccgcacccagctccgcaggaccggcgggcgcgcgcgggctctggaggccacgggcatgatgcttcgggtcctggtgggggctgtcctccctgccatgctactggctgccccaccacccatcaacaagctggcactgttcccagataagagtgcctggtgcgaagccaagaacatcacccagatcgtgggccacagcggctgtgaggccaagtccatccagaacagggcgtgcctaggacagtgcttcagctacagcgtccccaacaccttcccacagtccacagagtccctggttcactgtgactcctgcatgccagcccagtccatgtgggagattgtgacgctggagtgcccgggccacgaggaggtgcccagggtggacaagctggtggagaagatcctgcactgtagctgccaggcctgcggcaaggagcctagtcacgaggggctgagcgtctatgtgcagggcgaggacgggccgggatcccagcccggcacccaccctcacccccatccccacccccatcctggcgggcagacccctgagcccgaggacccccctggggccccccacacagaggaagagggggctgaggactgaggcccccccaactcttcctcccctctcatccccctgtggaatgttgggtctcactctctggggaagtcaggggagaagctgaagcccccctttggcactggatggacttggcttcagactcggacttgaatgctgcccggttgccatggagatctgaaggggcggggttagagccaagctgcacaatttaatatattcaagagtggggggaggaagcagaggtcttcagggctctttttttggggggggtggtctcttcctgtctggcttctagagatgtgcctgtgggagggggaggaagttggctgagccattgagtgctgggggaggccatccaagatggcatgaatcgggctaaggtccctgggggtgcagatggtactgctgaggtcccgggcttagtgtgagcatcttgccagcctcaggcttgagggagggctgggctagaaagaccactggcagaaacaggaggctccggcccacaggtttccccaaggcctctcaccccacttcccatctccagggaagcgtcgccccagtggcactgaagtggccctccctcagcggaggggtttgggagtcaggcctgggcaggaccctgctgactcgtggcgcgggagctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgccagagccggccgccttctcccctctcccagggatgctctttgtaaatatcggatgggtgtgggagtgaggggttacctccctcgccccaaggttccagaggccctaggcgggatgggctcgctgaacctcgaggaactccaggacgaggaggacatgggacttgcgtggacagtcagggttcacttgggctctctctagctccccaattctgcctgcctcctccctcccagctgcactttaaccctagaaggtggggacctggggggagggacagggcaggcgggcccatgaagaaagcccctcgttgcccagcactgtctgcgtctgctcttctgtgcccagggtggctgccagcccactgcctcctgcctggggtggcctggccctcctggctgttgcgacgcgggcttctggagcttgtcaccattggacagtctccctgatggaccctcagtcttctcatgaataaattccttcaacgcc

SEQ ID NO: 2762 - DNA, 12362 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactgtaccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaaga

SEQ ID NO: 2763 - DNA, 12425 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactgtaccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggcaacttgccactccctactgaataaagctacagtaaaagaaaaaaaggaaaacaaaaaatcagtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaaga

SEQ ID NO: 2764 - DNA, 1256 bp, Homo sapiens
aggcatgcatgagagatattccaacgtgcaagtggctggaccagtggacagaactagctcaaaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgact

SEQ ID NO: 2765 - DNA, 2939 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactgtaccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaacttt

SEQ ID NO: 2766 - DNA, 2028 bp, Homo sapiens
aggcatgcatgagagatattccaacgtgcaagtggctggaccagtggacagaactagctcaaagttctgtggatcttttaattgcagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaactagcacttcttaacctgctcactgcccatcagaacagcctctgacaaagctgcatccaaattctttaaagggcaattcattgccccaagtaatctgccaaacctgtcttcatttggaaatcagtcttcatattcagcactgctcagcacgc

SEQ ID NO: 2767 - DNA, 11031 bp, Homo sapiens
aattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccagcttctctgccttgctctaaatcagcagttttcatgcagctgttccctcatcaaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaaga

SEQ ID NO: 2768 - DNA, 2020 bp, Homo sapiens
tcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaacttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctcta

SEQ ID NO: 2769 - DNA, 6025 bp, Homo sapiens
cgcttcccgcgggcgcgcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 2770 - DNA, 5250 bp, Homo sapiens
tgcgcttcccgcgggcgcgcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaagaagcagattttagatgaaaagatctactgccctcctgaggcttctgtgctcctggcttcttacgccgtccaggccaagaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctgg

SEQ ID NO: 2771 - DNA, 1845 bp, Homo sapiens
cctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacc

SEQ ID NO: 2772 - DNA, 1837 bp, Homo sapiens
atggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcagg

SEQ ID NO: 2773 - DNA, 5884 bp, Homo sapiens
gatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctgg

SEQ ID NO: 2774 - DNA, 1716 bp, Homo sapiens
atggccggggccatcgcttcccgcatgagcttcagctctctcaagaggaagcaacccaagacgttcaccgtgaggatcgtcaccatggacgccgagatggagttcaattgcgaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaactcaccttgcagagcgccaagtcccgagtggccttctttgaagagctctagcaggtgacc

SEQ ID NO: 2775 - DNA, 1857 bp, Homo sapiens
atggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaagtaggttgttcccagctcaccttgcagagcgccaagtcccgagtggccttctttgaagagctctagcaggtgacc

SEQ ID NO: 2776 - DNA, 2335 bp, Homo sapiens
gatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagggtatgtttttgtttttcttcattttattttgctggtttagcctcaagcccaaggcagaagacctatctgcatttgagccctcaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctc

SEQ ID NO: 2777 - DNA, 2568 bp, Homo sapiens
gtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaacttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtcctttggagtcttccctgcagtttctgctcatagagtggaataagctcattggaacctttctaacaaaaagagatctggcataagatagatcctacttgtggtcgttatcccatcaagagaggtcagctgttaaagtccctgatagatcttattaaaaggtacacttgagctgtca

SEQ ID NO: 2778 - DNA, 2999 bp, Homo sapiens
gtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagcctcaagcccaaggcagaagacctatctgcatttgagccctcaaagtaggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctcta

SEQ ID NO: 2779 - DNA, 4733 bp, Homo sapiens
tgcgcttcccgcgggcgcgcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctgg

SEQ ID NO: 2780 - DNA, 1000 bp, Homo sapiens
tcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaagaagcagattttagatgaaaagatctactgccctcctgaggcttctgtgctcctggcttcttacgccgtccaggccaagaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaactcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagag

SEQ ID NO: 2781 - DNA, 5728 bp, Homo sapiens
gccaaaacctttgaccagagtctccttgccagcattcctacctccctttggccagctatttgtgccagttttttttttttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcccctctctctctctctcctctcccctttgtggattctttttggaaactgagcgaaatccaagatgctggcaccaagcgtattccgtgtggccctttggatggacatgctacctgaaacccagtgcccagaatatactagaatcaccgcatttcagtggactcctgaagttgtacttgtgtataattgcccgcgtcgtgcataggcaaagaaggattaggctgttttctttttaaagtactgtagcctcagtactggtgtagtgtgtcagctctgtttacgaagcaatactgtccagttttcttgctgtttttccggtgttgtactaaacctcgtgcttgtgaactccatacagaaaacggtgccatccctgaacacggctggccactgggtatactgctgacaaccgcaacaacaaaaacacaaatccttggcactggctagtctatgtcctctcaagtgcctttttgtttgtactggttcattgtgttacattaacgacccactctgcttcttgctggtgaaagccctgctctttaatcaaactctggtggcccactgactaagaagaaagtttattttcgtgtgagatgccagcccctccgggcaggcaagggctctgaagatttggcaacgtggcttaattgttctgctttttctgtagttcaatttcatgtttcttgacccttttgtataaagctacaatattctctcttattgttctttcatatggaatgtattttcaaatgtaaactctcttctctttctctctcctatctctctgtcttttttctctcttagaattggaggatttgccattgtccaggaaagaaacttgcagctttaacctgctgggaatggcaaacgattttactagactttatgtttaaaaataaataaataagggaaattcctaactttgccctccaaagtctaactttggttttcttgttaactggttaaagtgacagtatcttttttccttatctattctattcaaaatgacctttgatagaaatgttggcatttagtagaaatagtgataagttgaggaaagaaataatacaaattggctttcaagtgagacccaaaggaagaactggataaaatcttccaaatccaaaagcatgagatttttctatccaaatatgcaaaaatgacccaagagaactttcttattttgctactgagtcacacaagggaagtggaaggaagaacagttaatttaagaatgaaactataaatcctgatgcctgggggtcaagtattttaagataagagggggaaaaacacataaagtcaaacaaatgttttaaaaattcataacagcaaccttgaaaaaatagacttaaatgaatgcttctagaaacttccagcggctcacaaagaataagcctgccttagggctggcaacatctaagcctctaacagcacagggaagcaaatatcttaccaggcagcctatgaattaacccaaagaagctttggttggttttggtggatttttatcatgccatgttggacatgagattttttagatcttccttcccacattgctagacgtctcactcaaagacatttgttgggagtcacatttgcatcatagacgagacagtccattcatcttagttaaattggattgagaatgccttttgtttccaggaaaatattgatcaccatgaaagaagaatagttttttgtccccagagacattcatttagttgatataatcctaccagaaggaaagcactaagaaacactcgtttgttgtttttaaaggcaacagacttaaagttgtcctcagccaaggaaaaatgatactgcaactttaaaatttaaagtatcttgcactgataaatatatttaaaaattatatgtttataaagttattaatttgtaaaggcagtgttacaaaatgttcagtttatattgttttagattgttttgtaatttttaaaggtgtaaaataacatattttttctttatggaaatctataaaactttctgtagtaaaatgttttcattttactggtatattattgcttcatgttttgtaccatcataagattttgtgcagattttttttacagaaattattattttctatgacaatatgacacttgtaaattgttgtttcaaaatgaacagcgaagccttaactttaaatgacatttgtattctcagacactgagtagcataaaaaccacatagaactgaactgtaacttaaattccaaactatgactactacattccaaagaaacagttgaattaaacattttcataaaatatcccac

SEQ ID NO: 2782 - DNA, 2007 bp, Homo sapiens
atggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcaggctccagattcttcaagcatcatcacaagcagcagtcaatgagacctcaaaaccttcatcataattccattttgctattatag

SEQ ID NO: 2783 - DNA, 2804 bp, Homo sapiens
cttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaaggcactatcaacacagaccaagaatgtccatgtgccagggctttggcaaaggatgccaagaaaaagaagagatgggcagactccactcactgcagatgcgttcgttcaattcacggagaaatgtggtcatctggaaaaggagtctgctccctggatgcgaatctgtagcctggattctggaaggcgatgctgatttaggaggtggagtgaatggagaattgaaaagacagcctggtggcagttttgaaagcacgcttgcaaaaattgtaatgagaacatgatgacagtgaaagagatctgacctaactgactccatcttgcttctaacctccaagctgtccttgttcattcctgggcataggccaaactaactttaggaggaacttatagtttaactttgaaacaaagacaatgacagctctttcccaaaacaaacccccttcctgcctggggactagattgccttcgcaagactaacaaattagccacaaaattggaaattatggtttagggggaaaaaaatgaaattatggtttaggggtcatgcagctggaggctgcaagactctgaacctccccaaattgcttctgggaataatgtcactgttgtaaaacctgagatcagtgcttcagatattttccagaccctgtacttgatggatcagctggcaccacccagatcgataaactggctcatcctgtcttgtgtccctcaccagaaactgactcagcacaagaggacacctttgactccctgtgatttcacctcagacctgaccaatgagcacctgccccttttcaacccctgctcaacaaattacccttcaaaacctaaaccccaagtaataatagaacccccatctcccatacagttgtctctgcatgaattaaactctttctctattgc

SEQ ID NO: 2784 - DNA, 1110 bp, Homo sapiens
atggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggatgcaaaatacagactccgtgtatcagtggtgcgatcaaaatcttcctcttcaagcacatcattagaacccaggccattaagctcattgaaactgagtttcttttcctataaaataaaaataacgtag

SEQ ID NO: 2785 - DNA, 1988 bp, Homo sapiens
cttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaaggtggcaccactgtgctggccacagaaaagcccacggtcatagacagcaccatacaatcaggtatcaaataaaatacgaaatgtgacaga

SEQ ID NO: 2786 - DNA, 2213 bp, Homo sapiens
ggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcaggtatcaaataaaatacgaaatgtgacaga

SEQ ID NO: 2787 - DNA, 3737 bp, Homo sapiens
atggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtgcagaaaccatcttcatcccattgctgtaccatttcagttcatgtcttagttgggaccagctaacgcctgtgtgtgtgcttgtaactccgcatggcagagagctgcccaggaatagaagctgccttgccagaacacgtgcatcttcatttcctcatgtcatctggatagatgagttgttcttaatagccacaaccatttgtaacaataatttgagccatttcgagagccaaaggctaggattatcttaattgaataagaatttccccatggctaaatgtactaaaccgatccttattttcattattttcagacccccccccaataacacgtgcaccacccctacgtaaccacacacttcagaatgtttattttcattttctaatgaggacaagtttttttgagtggatcctttatccaacaaatggataaagttaggcttatatttgaagtgcggcttttaagttgggatttggtaaatcattgtacattaacatttacaaaggcagaattagctgctatttcacatcaccaccgaccagcaaatgcatcagagatgttgtgtgccaaatgtctcactaattaatctagagtattactctctaatctcctaaaaccctaaaagctaggaaatgaccttctcttccacttggaatggcagaggaaatattaggcaagtggagaaatgggattataccatttggaaattggccaaggcactagggttttcaccctgtggttgcaaaaggtatcgtgggacttttactgctccctgggtcaaaacgcagtttcaatagcatctgactctcatttgagattaaacatgagcttttgaatgcaggtctgcatttttacccagaagggactcggagagcccacataattaatttccatgggcaaaactgaaggcgttaccatgtaacttcataataaagccatgttattggctaatgcattcgtacaaaatctggaaggaagtgtcctagagtacatttccaattatttcaaaagctctcctctgaaggagtgagagggctctgcactctaagatggaataaagagtaaaagaaagaaaaaaaaattgaaaatctgtcccagaaatttagtactgtgaactgagtttacatttaaatcccacctcctaaagctgtctctctccaaatttccaggataatcatttacattcatatggccaataaatgtcacattgctatgagcttttgaatgcaaatcttgtatacaagcagccacaagccacaaaacttagattaattaatgcagagacattttctgtgtaacatgtcaagttcaagttgaaaactcaaccactgatataaaaaacagagtactattccatgaaccaagtcctctggaagcttcccggggttgcctgtaaacactctgccacaaacctcaggctttttacagaccccgtcacacatccatagtgaaatttctcataaaaaaggaatgattgcaggatcccagtgtgccctttcaattgccctcttgtggaaggggttcttttcttcataaaccctaaagtggtcagttaatattgattagaaacaaagcctcagatttactcctcatatcagaacaaccagccttctcatttttgcattagttcatgactgaatcaattgaaactgaaggctttgaatgaaatagggcgagtatgttagcctggagcaaattgtgtatggcagcgagttacaaaccacagaaaatgggtcatttatagtggaaacactgacaacctttcaaaactataaggttttgctttacctacagtgtttcaattatttctttggtagatagaagaaagttcattctgattttttctttttacatattagcatggtgaaaaaaa

SEQ ID NO: 2788 - DNA, 2252 bp, Homo sapiens
ggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagccaggctggaagtttccacattgaacctctcactccataaccctccccaacaaaaggcattgatctaa

SEQ ID NO: 2789 - DNA, 5877 bp, Homo sapiens
gcagttggtgaaactcctctgtctcccgctcatcttttcattgctcgttcccctccttcccgcagacacccggacctcccctgggcgccagctccgcggctccaacgggtccagaaacaagccggattttttttttttcttcctggaaattggctttggtgtgtgttgccctacctccctcctccccctcccacccacagcccccccccggccttttttttttttttttttttttttgagacatggcccgggcagtggctcctggaagaggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcccctctctctctctctcctctcccctttgtggattctttttggaaactgagcgaaatccaagatgctggcaccaagcgtattccgtgtggccctttggatggacatgctacctgaaacccagtgcccagaatatactagaatcaccgcatttcagtggactcctgaagttgtacttgtgtataattgcccgcgtcgtgcataggcaaagaaggattaggctgttttctttttaaagtactgtagcctcagtactggtgtagtgtgtcagctctgtttacgaagcaatactgtccagttttcttgctgtttttccggtgttgtactaaacctcgtgcttgtgaactccatacagaaaacggtgccatccctgaacacggctggccactgggtatactgctgacaaccgcaacaacaaaaacacaaatccttggcactggctagtctatgtcctctcaagtgcctttttgtttgtactggttcattgtgttacattaacgacccactctgcttcttgctggtgaaagccctgctctttaatcaaactctggtggcccactgactaagaagaaagtttattttcgtgtgagatgccagcccctccgggcaggcaagggctctgaagatttggcaacgtggcttaattgttctgctttttctgtagttcaatttcatgtttcttgacccttttgtataaagctacaatattctctcttattgttctttcatatggaatgtattttcaaatgtaaactctcttctctttctctctcctatctctctgtcttttttctctcttagaattggaggatttgccattgtccaggaaagaaacttgcagctttaacctgctgggaatggcaaacgattttactagactttatgtttaaaaataaataaataagggaaattcctaactttgccctccaaagtctaactttggttttcttgttaactggttaaagtgacagtatcttttttccttatctattctattcaaaatgacctttgatagaaatgttggcatttagtagaaatagtgataagttgaggaaagaaataatacaaattggctttcaagtgagacccaaaggaagaactggataaaatcttccaaatccaaaagcatgagatttttctatccaaatatgcaaaaatgacccaagagaactttcttattttgctactgagtcacacaagggaagtggaaggaagaacagttaatttaagaatgaaactataaatcctgatgcctgggggtcaagtattttaagataagagggggaaaaacacataaagtcaaacaaatgttttaaaaattcataacagcaaccttgaaaaaatagacttaaatgaatgcttctagaaacttccagcggctcacaaagaataagcctgccttagggctggcaacatctaagcctctaacagcacagggaagcaaatatcttaccaggcagcctatgaattaacccaaagaagctttggttggttttggtggatttttatcatgccatgttggacatgagattttttagatcttccttcccacattgctagacgtctcactcaaagacatttgttgggagtcacatttgcatcatagacgagacagtccattcatcttagttaaattggattgagaatgccttttgtttccaggaaaatattgatcaccatgaaagaagaatagttttttgtccccagagacattcatttagttgatataatcctaccagaaggaaagcactaagaaacactcgtttgttgtttttaaaggcaacagacttaaagttgtcctcagccaaggaaaaatgatactgcaactttaaaatttaaagtatcttgcactgataaatatatttaaaaattatatgtttataaagttattaatttgtaaaggcagtgttacaaaatgttcagtttatattgttttagattgttttgtaatttttaaaggtgtaaaataacatattttttctttatggaaatctataaaactttctgtagtaaaatgttttcattttactggtatattattgcttcatgttttgtaccatcataagattttgtgcagattttttttacagaaattattattttctatgacaatatgacacttgtaaattgttgtttcaaaatgaacagcgaagccttaactttaaatgacatttgtattctcagacactgagtagcataaaaaccacatagaactgaactgtaacttaaattccaaactatgactactacattccaaagaaacagttgaattaaacattttcataaaatatccc

SEQ ID NO: 2790 - DNA, 5407 bp, Homo sapiens
ggaacaagtgtgggaaaagggagaggaagccggagctaaatgacaggatgcaggcgacttgagacacaaaaagagaagcgttcctctcggatccaggcattgcctcgctgctttcttttctccaagacgggctgaggattgtacagctctaggcggagttggggctcttcggatcgcttagattctcctctttgctgcatttccccccacgtcctcgttctcccgcgtctgcctgcggacccggagaagggagaatggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcaccatcggactcatgtgcagtcagcttttttcctgttggtttcatttgaataatcagatgctggtgttgagaccaagtatgattgacataatcattcatttcgacccctcctgcccctctctctctctctcctctcccctttgtggattctttttggaaactgagcgaaatccaagatgctggcaccaagcgtattccgtgtggccctttggatggacatgctacctgaaacccagtgcccagaatatactagaatcaccgcatttcagtggactcctgaagttgtacttgtgtataattgcccgcgtcgtgcataggcaaagaaggattaggctgttttctttttaaagtactgtagcctcagtactggtgtagtgtgtcagctctgtttacgaagcaatactgtccagttttcttgctgtttttccggtgttgtactaaacctcgtgcttgtgaactccatacagaaaacggtgccatccctgaacacggctggccactgggtatactgctgacaaccgcaacaacaaaaacacaaatccttggcactggctagtctatgtcctctcaagtgcctttttgtttgtactggttcattgtgttacattaacgacccactctgcttcttgctggtgaaagccctgctctttaatcaaactctggtggcccactgactaagaagaaagtttattttcgtgtgagatgccagcccctccgggcaggcaagggctctgaagatttggcaacgtggcttaattgttctgctttttctgtagttcaatttcatgtttcttgacccttttgtataaagctacaatattctctcttattgttctttcatatggaatgtattttcaaatgtaaactctcttctctttctctctcctatctctctgtcttttttctctcttagaattggaggatttgccattgtccaggaaagaaacttgcagctttaacctgctgggaatggcaaacgattttactagactttatgtttaaaaataaataaataagggaaattcctaactttgccctccaaagtctaactttggttttcttgttaactggttaaagtgacagtatcttttttccttatctattctattcaaaatgacctttgatagaaatgttggcatttagtagaaatagtgataagttgaggaaagaaataatacaaattggctttcaagtgagacccaaaggaagaactggataaaatcttccaaatccaaaagcatgagatttttctatccaaatatgcaaaaatgacccaagagaactttcttattttgctactgagtcacacaagggaagtggaaggaagaacagttaatttaagaatgaaactataaatcctgatgcctgggggtcaagtattttaagataagagggggaaaaacacataaagtcaaacaaatgttttaaaaattcataacagcaaccttgaaaaaatagacttaaatgaatgcttctagaaacttccagcggctcacaaagaataagcctgccttagggctggcaacatctaagcctctaacagcacagggaagcaaatatcttaccaggcagcctatgaattaacccaaagaagctttggttggttttggtggatttttatcatgccatgttggacatgagattttttagatcttccttcccacattgctagacgtctcactcaaagacatttgttgggagtcacatttgcatcatagacgagacagtccattcatcttagttaaattggattgagaatgccttttgtttccaggaaaatattgatcaccatgaaagaagaatagttttttgtccccagagacattcatttagttgatataatcctaccagaaggaaagcactaagaaacactcgtttgttgtttttaaaggcaacagacttaaagttgtcctcagccaaggaaaaatgatactgcaactttaaaatttaaagtatcttgcactgataaatatatttaaaaattatatgtttataaagttattaatttgtaaaggcagtgttacaaaatgttcagtttatattgttttagattgttttgtaatttttaaaggtgtaaaataacatattttttctttatggaaatctataaaactttctgtagtaaaatgttttcattttactggtatattattgcttcatgttttgtaccatcataagattttgtgcagattttttttacagaaattattattttctatgacaatatgacacttgtaaattgttgtttcaaaatgaacagcgaagccttaactttaaatgacatttgtattctcagacactgagtagcataaaaaccacatagaactgaactgtaacttaaattccaaactatgactactacattccaaagaaacagttgaattaaacattttcataaaatatcccac

SEQ ID NO: 2791 - DNA, 2721 bp, Homo sapiens
atggagagggggctgccgctcctctgcgccgtgctcgccctcgtcctcgccccggccggcgcttttcgcaacgataaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatga

SEQ ID NO: 2792 - DNA, 497 bp, Homo sapiens
aaccacatttcacaagaagattgtgcaaggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatgaaggcagacagagatgaaaagacagtcaaaggacggaagtggaaggacgggagtgagctggggagctgttgatctttcactatacaggctgggaagtgtgttgatgaccactgagccaggcttttctcaggagcttcaatgagtatggccgacagacatggacaaggagctgtgttcacc

SEQ ID NO: 2793 - DNA, 574 bp, Homo sapiens
cccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagccaggctggaagtttccacattgaacctctcactccataaccctccccaacaaaaggcattgatctaaaaacatatcctttaaataaccaaattgccacaagttacatgatcaagacaagaagataaaagagcagtaaaatacaaaaacttagagcggttcacctggttaaatgtacaggatggggaaggacattggaaggtaaaggcagactgtcattctctgaagcgagaagtgcctgaaacattttttcaggcaaagcggttccatgtcctggtcatttcaaaaatatccaagttcctacattttatggtatcatcagaatatgaagagccaaaagaatggatgatgtcattttctgttctataaacaataaatgtaatgtattaacaaagtaaatacaggcagaa

SEQ ID NO: 2794 - DNA, 372 bp, Homo sapiens
ccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcaggctccagattcttcaagcatcatcacaagcagcagtcaatgagacctcaaaaccttcatcataattccattttgctattatagactcaactcagagtcttactatttcatcttgctgattctcatcaatataataaactccatgggcatataa

SEQ ID NO: 2795 - DNA, 709 bp, Homo sapiens
gtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaaggtgagggctggggactgggaggaggtcatcccttatgtccttgacttcaatcaagggcctctggcattctcccgag

SEQ ID NO: 2796 - DNA, 518 bp, Homo sapiens
tccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggatgcaaaatacagactccgtgtatcagtggtgcgatcaaaatcttcctcttcaagcacatcattagaacccaggccattaagctcattgaaactgagtttcttttcctataaaataaaaataacgtagccttcac

SEQ ID NO: 2797 - DNA, 3351 bp, Homo sapiens
atggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaggttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcaggtgagaattttaaagggggcaccctcctgccagggaccgagcccacagtggacacggtgcccatgcagcccatcccagcctactggtattacgtaatggccgccgggggcgccgtgctggtgctggtctccgtcgcgctggccctggtgctccactaccaccggttccgctatgcggccaagaagaccgatcactccatcacctacaaaacctcccactacaccaacggggcccctctggcggtggagcccaccctaaccattaagctagagcaagaccgtggctcgcactgctgagggccgaagcaagaacagcacccaaaacaaacgagaaagactgcaaacatgttgcctcgattttgcacttttttctcctcgcctagtttctgtgtgaactctcagacatctctttcccggatccccaaccctgagcactcttatcaatcccaaccatcctccttgggttcattttggtttctggtttttctttttcctttttgttgattccaaaccaacaaacccaactctaatgctgcatcttggactatccgaagagatccacccccaagcactccacaactcaaggctcagctggttttgttccagagactggttcgcttgttttttccccttgccttatcccatacctcctctcagtgggcagtctgccaggagacgtgaggggaagcctggatctgtgtgtatgtacatagtagacatgtgtgtgtgtgaatagctctctgtgtgtgggtgtgtgagagagcggctggttcattgtgtgtgtgtttgggcgaggggtgagtgttcagagagggcccctttaactcttatgttacttctcctggggtacattttacaagaaaataatatactgtacaagttttgtttacttggagaagagattgaagctttttgttgccttatcta

SEQ ID NO: 2798 - DNA, 1551 bp, Homo sapiens
gcagagcatgtttgggacataacaaaggatctgagtagtaaacaccgtacgccacccaactcctcttgtaacgccatcgcgcgtggcattgtgttgggttctgcgtgtgtggcatcggagtcgtggaatttagggggaacaaggcttttccccccgtccccccggggtctcccttgggtgggggcgacacggccaaggcggcgcgccctgggggtgcccgggggcgcttcttccccagggcgttacgcaccggcggcccggcgcggaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaacttgctgtctgcttggaaaatttcactcacaagccgcagctttgcctgactcagtgcaatccaaggccaccatctctggtgaacttcccttgactcctccctccagccacttgcagaaatgcaaatcctgggcacccacaggctgtttgggggcctgtatagaagctgtgggcagaaaccagaggccactgtggtactgctggactcctgcagccaaaggacaaaagggcgagactacgggccgtctgggcaaacagagagaagccactttattccctgtggagtggaggatgctaggatgttgctgctccggcagacagaggcctttcgcttgagtcatcagccaacagactgaatgttatggttttagaaacccatacacaaagttgagtggttttttccatttctaaaatttaaaatgtatgtatttttaaaacacccacctgcatgtaatacacagcttgttcaggagttctcaaacagccccagcacccaccccatcccagaggctcaaccaaataaaaccaaaaccaggaggctgggtccttttaagcactggtaatttctacctgtaattccagccctttgggaggccgaggcaggcaggtcacctgaggtcaggagttcgagaccagcctggtcaacatggtgaaaccccgtctctactaaaaatacaaaaaaaattagccaagcttggtggtgcgtgcctgtaatctcagctactctggaggctgaggcaggagaatcacttgaacctgggaggcagaggctgcagtgagctgagattgtgccactgcactccggcctgggtgaaagagtgagactctgtctc

SEQ ID NO: 2799 - DNA, 2577 bp, Homo sapiens
cagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaggttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaaggtaggctgttcttggaggcctctgtaacgttaccctcaacagggaggctaagtgtggtacagggagttgagactgatgatgtcccatctaaacagtcgtcatccaactcctgaaatccaataaaacaaatatcgtttgagagatt

SEQ ID NO: 2800 - DNA, 3367 bp, Homo sapiens
cccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaggttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagggggcaccctcctgccagggaccgagcccacagtggacacggtgcccatgcagcccatcccagcctactggtattacgtaatggccgccgggggcgccgtgctggtgctggtctccgtcgcgctggccctggtgctccactaccaccggttccgctatgcggccaagaagaccgatcactccatcacctacaaaacctcccactacaccaacggggcccctctggcggtggagcccaccctaaccattaagctagagcaagaccgtggctcgcactgctgagggccgaagcaagaacagcacccaaaacaaacgagaaagactgcaaacatgttgcctcgattttgcacttttttctcctcgcctagtttctgtgtgaactctcagacatctctttcccggatccccaaccctgagcactcttatcaatcccaaccatcctccttgggttcattttggtttctggtttttctttttcctttttgttgattccaaaccaacaaacccaactctaatgctgcatcttggactatccgaagagatccacccccaagcactccacaactcaaggctcagctggttttgttccagagactggttcgcttgttttttccccttgccttatcccatacctcctctcagtgggcagtctgccaggagacgtgaggggaagcctggatctgtgtgtatgtacatagtagacatgtgtgtgtgtgaatagctctctgtgtgtgggtgtgtgagagagcggctggttcattgtgtgtgtgtttgggcgaggggtgagtgttcagagagggcccctttaactcttatgttacttctcctggggtacattttacaagaaaataatatactgtacaagttttgtttacttggagaagagattgaagctttttgttgccttatcta

SEQ ID NO: 2801 - DNA, 2926 bp, Homo sapiens
cccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaggttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccag

SEQ ID NO: 2802 - DNA, 6662 bp, Homo sapiens
cagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaggttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcaggtgagaattttaaagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgatttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcataagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagagata

SEQ ID NO: 2803 - DNA, 2730 bp, Homo sapiens
atggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaggttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatga

SEQ ID NO: 2804 - DNA, 2386 bp, Homo sapiens
cgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaggttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaaggtaggctgttcttggaggcctctgtaacgttaccctcaacagggaggctaagtgtggtacagggagttgagactgatgatgtcccatctaaacagtcgtcatccaactcctgaaatccaataaaacaaatatcgtttgagagatta

SEQ ID NO: 2805 - DNA, 583 bp, Homo sapiens
agagatcgcgagcgaggcaccagcctgcagccggcccccagcacatcctcagccgcacagacactcggcgaggtggaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctggg
